US012516322B2

(12) United States Patent
Farley et al.

(10) Patent No.: US 12,516,322 B2

(45) Date of Patent: Jan. 6, 2026

(54) MICROTUBULE ASSOCIATED PROTEIN TAU (MAPT) iRNA AGENT COMPOSITIONS AND METHODS OF USE THEREOF

(71) Applicant: ALNYLAM PHARMACEUTICALS, INC., Cambridge, MA (US)

(72) Inventors: Jonathan Edward Farley, Boston, MA (US); Mark K. Schlegel, Lexington, MA (US); James D. McIninch, Burlington, MA (US); Jeffrey Zuber, Somerville, MA (US); Adam Castoreno, Framingham, MA (US); Stephen Abbott, Lexington, MA (US); Joseph Barry, Arlington, MA (US)

(73) Assignee: Alnylam Pharmaceuticals, Inc., Cambridge, MA (US)

(*) Notice: Subject to any disclaimer, the term of this patent is extended or adjusted under 35 U.S.C. 154(b) by 0 days.

(21) Appl. No.: 18/532,300

(22) Filed: Dec. 7, 2023

(65) Prior Publication Data

US 2024/0254487 A1 Aug. 1, 2024

Related U.S. Application Data

(63) Continuation of application No. PCT/US2022/076979, filed on Sep. 23, 2022.

(60) Provisional application No. 63/403,327, filed on Sep. 2, 2022, provisional application No. 63/321,573, filed on Mar. 18, 2022, provisional application No. 63/248,119, filed on Sep. 24, 2021.

(51) Int. Cl.

| | |
|---|---|
| ***C12N 15/113*** | (2010.01) |
| ***A61K 48/00*** | (2006.01) |
| ***C12N 15/85*** | (2006.01) |

(52) U.S. Cl.

CPC .......... *C12N 15/113* (2013.01); *A61K 48/005* (2013.01); *C12N 15/85* (2013.01); *C12N 2310/14* (2013.01); *C12N 2310/315* (2013.01)

(58) Field of Classification Search

CPC .. C12N 15/113; C12N 15/85; C12N 2310/14; C12N 2310/315; C12N 2310/3125; C12N 2310/321; C12N 2310/322; C12N 2310/351; C12N 2310/3521; C12N 2310/3527; C12N 2310/3533; C12N 2310/312; C12N 2310/3515; A61K 48/005; A61K 31/7088; A61K 31/713; A61P 25/28

See application file for complete search history.

(56) References Cited

U.S. PATENT DOCUMENTS

| | | | |
|---|---|---|---|
| 3,228,831 | A | 1/1966 | Nicholson et al. |
| 3,687,808 | A | 8/1972 | Merigan, Jr. et al. |
| 3,904,682 | A | 9/1975 | Fried et al. |
| 4,009,197 | A | 2/1977 | Fried et al. |
| 4,469,863 | A | 9/1984 | Ts'o et al. |
| 4,476,301 | A | 10/1984 | Imbach et al. |
| 4,587,044 | A | 5/1986 | Miller et al. |
| 4,605,735 | A | 8/1986 | Miyoshi et al. |
| 4,667,025 | A | 5/1987 | Miyoshi et al. |
| 4,683,202 | A | 7/1987 | Mullis |
| 4,762,779 | A | 8/1988 | Snitman |
| 4,789,737 | A | 12/1988 | Miyoshi et al. |
| 4,824,941 | A | 4/1989 | Gordon et al. |
| 4,828,979 | A | 5/1989 | Klevan et al. |
| 4,835,263 | A | 5/1989 | Nguyen et al. |
| 4,837,028 | A | 6/1989 | Allen |
| 4,845,205 | A | 7/1989 | Huynh Dinh et al. |
| 4,876,335 | A | 10/1989 | Yamane et al. |
| 4,897,355 | A | 1/1990 | Eppstein et al. |
| 4,904,582 | A | 2/1990 | Tullis |
| 4,948,882 | A | 8/1990 | Ruth |
| 4,958,013 | A | 9/1990 | Letsinger |
| 4,981,957 | A | 1/1991 | Lebleu et al. |
| 5,023,243 | A | 6/1991 | Tullis |
| 5,034,506 | A | 7/1991 | Summerton et al. |
| 5,082,830 | A | 1/1992 | Brakel et al. |
| 5,109,124 | A | 4/1992 | Ramachandran et al. |
| 5,112,963 | A | 5/1992 | Pieles et al. |
| 5,118,800 | A | 6/1992 | Smith et al. |
| 5,118,802 | A | 6/1992 | Smith et al. |

(Continued)

FOREIGN PATENT DOCUMENTS

| | | |
|---|---|---|
| WO | WO 1988/04924 | 7/1988 |
| WO | WO 1991/16024 | 10/1991 |

(Continued)

OTHER PUBLICATIONS

Naito et al., Designing Functional siRNA with Reduced Off-Target Effects, 2013, in siRNA design, Methods and Protocol, Methods in Mol. Biol., 942, p. 57-68, (Year: 2013).*

Du et al., A systematic analysis of the silencing effects of an active siRNA at all single-nucleotide mismatched target sites, 2005, Nucleic Acid Research, 33, 1671-1677. (Year: 2005).*

Ui-Tei et al., Functional dissection of siRNA sequence by systematic DNA substitution: modified siRNA with a DNA seed arm is a powerful tool for mammalian gene silencing with significantly reduced off-target effect, 2008, Nucleic Acids Research, 36, 2136-2151, (Year: 2008).*

Hough et al., Why RNAi makes sense, 2003, Nature Biotechnology, 21, 731-732. (Year: 2003).*

(Continued)

*Primary Examiner* — Soren Harward
*Assistant Examiner* — Keyur A Vyas
(74) *Attorney, Agent, or Firm* — Womble Bond Dickinson (US) LLP

(57) ABSTRACT

The disclosure relates to double stranded ribonucleic acid interference (dsRNAi) agents and compositions targeting a microtubule-associated protein tau (MAPT) gene, as well as methods of inhibiting expression of a MAPT gene and methods of treating subjects having a MAPT-associated disease or disorder, e.g., Alzheimer's disease, frontotemporal dementia, progressive supranuclear palsy, or other tauopathies, using such dsRNAi agents and compositions.

29 Claims, 13 Drawing Sheets

Specification includes a Sequence Listing.

(56) References Cited

U.S. PATENT DOCUMENTS 5,130,302 A 7/1992 Spielvogel et al.
5,134,066 A 7/1992 Rogers et al.
5,138,045 A 8/1992 Cook et al.
5,166,315 A 11/1992 Summerton et al.
5,171,678 A 12/1992 Behr et al.
5,175,273 A 12/1992 Bischofberger et al.
5,177,195 A 1/1993 Gregory et al.
5,185,444 A 2/1993 Summerton et al.
5,188,897 A 2/1993 Suhadolnik et al.
5,214,134 A 5/1993 Weis et al.
5,214,136 A 5/1993 Lin et al.
5,216,141 A 6/1993 Benner
5,218,105 A 6/1993 Cook et al.
5,235,033 A 8/1993 Summerton et al.
5,245,022 A 9/1993 Weis et al.
5,254,469 A 10/1993 Warren, III et al.
5,258,506 A 11/1993 Urdea et al.
5,262,536 A 11/1993 Hobbs, Jr.
5,264,423 A 11/1993 Cohen et al.
5,264,562 A 11/1993 Matteucci
5,264,564 A 11/1993 Matteucci
5,272,250 A 12/1993 Spielvogel et al.
5,276,019 A 1/1994 Cohen et al.
5,278,302 A 1/1994 Caruthers et al.
5,283,185 A 2/1994 Epand et al.
5,286,717 A 2/1994 Cohen et al.
5,292,873 A 3/1994 Rokita et al.
5,317,098 A 5/1994 Shizuya et al.
5,319,080 A 6/1994 Leumann
5,321,131 A 6/1994 Agrawal et al.
5,359,044 A 10/1994 Cook et al.
5,367,066 A 11/1994 Urdea et al.
5,371,241 A 12/1994 Brush
5,391,723 A 2/1995 Priest
5,393,878 A 2/1995 Leumann
5,399,676 A 3/1995 Froehler
5,405,938 A 4/1995 Summerton et al.
5,405,939 A 4/1995 Suhadolnik et al.
5,414,077 A 5/1995 Lin et al.
5,416,203 A 5/1995 Letsinger
5,432,272 A 7/1995 Benner
5,434,257 A 7/1995 Matteucci et al.
5,445,934 A 8/1995 Fodor et al.
5,446,137 A 8/1995 Maag et al.
5,451,463 A 9/1995 Nelson et al.
5,453,496 A 9/1995 Caruthers et al.
5,455,233 A 10/1995 Spielvogel et al.
5,457,187 A 10/1995 Gmeiner et al.
5,459,255 A 10/1995 Cook et al.
5,466,677 A 11/1995 Baxter et al.
5,466,786 A 11/1995 Buhr et al.
5,470,967 A 11/1995 Huie et al.
5,476,925 A 12/1995 Letsinger et al.
5,484,908 A 1/1996 Froehler et al.
5,486,603 A 1/1996 Buhr
5,489,677 A 2/1996 Sanghvi et al.
5,502,177 A 3/1996 Matteucci et al.
5,510,475 A 4/1996 Agrawal et al.
5,512,439 A 4/1996 Hornes et al.
5,512,667 A 4/1996 Reed et al.
5,514,785 A 5/1996 Van Ness et al.
5,519,126 A 5/1996 Hecht
5,519,134 A 5/1996 Acevedo et al.
5,525,465 A 6/1996 Haralambidis et al.
5,525,711 A 6/1996 Hawkins et al.
5,536,821 A 7/1996 Agrawal et al.
5,539,082 A 7/1996 Nielsen et al.
5,541,307 A 7/1996 Cook et al.
5,541,313 A 7/1996 Ruth
5,541,316 A 7/1996 Engelskirchen et al.
5,543,152 A 8/1996 Webb et al.
5,545,730 A 8/1996 Urdea et al.
5,550,111 A 8/1996 Suhadolnik et al.
5,552,538 A 9/1996 Urdea et al.
5,552,540 A 9/1996 Haralambidis
5,561,225 A 10/1996 Maddry et al.
5,563,253 A 10/1996 Agrawal et al.
5,565,552 A 10/1996 Magda et al.
5,567,810 A 10/1996 Weis et al.
5,567,811 A 10/1996 Misiura et al.
5,571,799 A 11/1996 Tkachuk et al.
5,574,142 A 11/1996 Meyer, Jr. et al.
5,576,427 A 11/1996 Cook et al.
5,578,717 A 11/1996 Urdea et al.
5,578,718 A 11/1996 Cook et al.
5,580,731 A 12/1996 Chang et al.
5,585,481 A 12/1996 Arnold, Jr. et al.
5,587,361 A 12/1996 Cook et al.
5,587,371 A 12/1996 Sessler et al.
5,587,469 A 12/1996 Cook et al.
5,591,584 A 1/1997 Chang et al.
5,591,722 A 1/1997 Montgomery et al.
5,594,121 A 1/1997 Froehler et al.
5,595,726 A 1/1997 Magda et al.
5,596,086 A 1/1997 Matteucci et al.
5,596,091 A 1/1997 Switzer
5,597,696 A 1/1997 Linn et al.
5,597,909 A 1/1997 Urdea et al.
5,599,923 A 2/1997 Sessler et al.
5,599,928 A 2/1997 Hemmi et al.
5,602,240 A 2/1997 De Mesmaeker et al.
5,608,046 A 3/1997 Cook et al.
5,610,289 A 3/1997 Cook et al.
5,610,300 A 3/1997 Altmann et al.
5,614,617 A 3/1997 Cook et al.
5,618,704 A 4/1997 Sanghvi et al.
5,623,070 A 4/1997 Cook et al.
5,625,050 A 4/1997 Beaton et al.
5,627,053 A 5/1997 Usman et al.
5,633,360 A 5/1997 Bischofberger et al.
5,639,873 A 6/1997 Barascut et al.
5,646,265 A 7/1997 McGee
5,658,873 A 8/1997 Bertsch-Frank et al.
5,663,312 A 9/1997 Chaturvedula
5,670,633 A 9/1997 Cook et al.
5,677,195 A 10/1997 Winkler et al.
5,677,437 A 10/1997 Teng et al.
5,677,439 A 10/1997 Weis et al.
5,681,941 A 10/1997 Cook et al.
5,688,941 A 11/1997 Cook et al.
5,700,920 A 12/1997 Altmann et al.
5,705,188 A 1/1998 Junichi et al.
5,714,331 A 2/1998 Buchardt et al.
5,719,262 A 2/1998 Buchardt et al.
5,744,305 A 4/1998 Fodor et al.
5,750,692 A 5/1998 Cook et al.
5,770,722 A 6/1998 Lockhart et al.
5,854,033 A 12/1998 Lizardi
5,874,219 A 2/1999 Rava et al.
5,976,567 A 11/1999 Wheeler et al.
5,981,501 A 11/1999 Wheeler et al.
6,015,886 A 1/2000 Dale et al.
6,028,188 A 2/2000 Arnold, Jr. et al.
6,054,299 A 4/2000 Conrad
6,124,445 A 9/2000 Imbach et al.
6,147,200 A 11/2000 Manoharan et al.
6,160,109 A 12/2000 Just et al.
6,166,197 A 12/2000 Cook et al.
6,169,170 B1 1/2001 Gryaznov et al.
6,172,209 B1 1/2001 Manoharan et al.
6,191,105 B1 2/2001 Ekwuribe et al.
6,222,025 B1 4/2001 Cook et al.
6,235,887 B1 5/2001 Froehler et al.
6,239,265 B1 5/2001 Cook
6,268,490 B1 7/2001 Imanishi et al.
6,277,603 B1 8/2001 Cook
6,294,664 B1 9/2001 Ravikumar et al.
6,320,017 B1 11/2001 Ansell
6,326,199 B1 12/2001 Cook et al.
6,346,614 B1 2/2002 Metelev et al.
6,380,368 B1 4/2002 Froehler et al.
6,444,423 B1 9/2002 Meade et al.
6,525,191 B1 2/2003 Ramasamy
6,528,640 B1 3/2003 Beigelman et al.

(56) References Cited

U.S. PATENT DOCUMENTS

| | | | |
|---|---|---|---|
| 6,531,590 | B1 | 3/2003 | Manoharan et al. |
| 6,534,484 | B1 | 3/2003 | Wheeler et al. |
| 6,534,639 | B1 | 3/2003 | Manoharan et al. |
| 6,576,752 | B1 | 6/2003 | Manoharan et al. |
| 6,586,410 | B1 | 7/2003 | Wheeler et al. |
| 6,608,035 | B1 | 8/2003 | Agrawal et al. |
| 6,617,438 | B1 | 9/2003 | Beigelman et al. |
| 6,639,062 | B2 | 10/2003 | Manoharan et al. |
| 6,670,461 | B1 | 12/2003 | Wengel et al. |
| 6,683,167 | B2 | 1/2004 | Metelev et al. |
| 6,747,014 | B2 | 6/2004 | Teng et al. |
| 6,770,748 | B2 | 8/2004 | Imanishi et al. |
| 6,783,931 | B1 | 8/2004 | Cook et al. |
| 6,783,961 | B1 | 8/2004 | Edwards et al. |
| 6,794,499 | B2 | 9/2004 | Wengel et al. |
| 6,815,432 | B2 | 11/2004 | Wheeler et al. |
| 6,858,225 | B2 | 2/2005 | Semple et al. |
| 6,858,715 | B2 | 2/2005 | Ravikumar et al. |
| 6,867,294 | B1 | 3/2005 | Sanghvi et al. |
| 6,878,805 | B2 | 4/2005 | Manoharan et al. |
| 6,887,906 | B1 | 5/2005 | Teng et al. |
| 6,900,297 | B1 | 5/2005 | Cook et al. |
| 6,998,484 | B2 | 2/2006 | Koch et al. |
| 7,015,315 | B1 | 3/2006 | Cook et al. |
| 7,034,133 | B2 | 4/2006 | Wengel et al. |
| 7,037,646 | B1 | 5/2006 | Cook et al. |
| 7,041,816 | B2 | 5/2006 | Ravikumar et al. |
| 7,045,610 | B2 | 5/2006 | Dempcy et al. |
| 7,053,207 | B2 | 5/2006 | Wengel |
| 7,063,860 | B2 | 6/2006 | Chancellor et al. |
| 7,070,802 | B1 | 7/2006 | Bhalani et al. |
| 7,084,125 | B2 | 8/2006 | Wengel |
| RE39,464 | E | 1/2007 | Cook et al. |
| 7,157,099 | B2 | 1/2007 | Autuori et al. |
| 7,273,933 | B1 | 9/2007 | Krotz et al. |
| 7,321,029 | B2 | 1/2008 | Gryaznov et al. |
| 7,399,845 | B2 | 7/2008 | Seth et al. |
| 7,427,605 | B2 | 9/2008 | Davis et al. |
| 7,427,672 | B2 | 9/2008 | Imanishi et al. |
| 7,495,088 | B1 | 2/2009 | Brakel et al. |
| 7,569,686 | B1 | 8/2009 | Bhat et al. |
| 7,626,014 | B2 | 12/2009 | Manoharan et al. |
| 7,741,457 | B2 | 6/2010 | Seth et al. |
| 7,858,769 | B2 | 12/2010 | Jadhav et al. |
| 8,022,193 | B2 | 9/2011 | Seth et al. |
| 8,030,467 | B2 | 10/2011 | Seth et al. |
| 8,058,069 | B2 | 11/2011 | Yaworski et al. |
| 8,101,348 | B2 | 1/2012 | Tuschl et al. |
| 8,106,022 | B2 | 1/2012 | Manoharan et al. |
| 8,158,601 | B2 | 4/2012 | Chen et al. |
| 8,278,283 | B2 | 10/2012 | Seth et al. |
| 8,278,425 | B2 | 10/2012 | Prakash et al. |
| 8,278,426 | B2 | 10/2012 | Seth et al. |
| 8,314,227 | B2 | 11/2012 | Wengel |
| 8,779,116 | B2 | 7/2014 | Davidson et al. |
| 8,962,580 | B2 | 2/2015 | Manoharan et al. |
| 8,993,738 | B2 | 3/2015 | Prakash et al. |
| 9,198,982 | B2 | 12/2015 | Roberson et al. |
| 9,644,207 | B2 | 5/2017 | Rigo et al. |
| 9,683,235 | B2 * | 6/2017 | Freier ..................... A61P 25/08 |
| 10,087,210 | B2 | 10/2018 | Prakash et al. |
| 10,273,474 | B2 | 4/2019 | Miller et al. |
| 10,407,680 | B2 | 9/2019 | Kordasiewicz |
| 10,513,701 | B2 | 12/2019 | Covello et al. |
| 10,793,856 | B2 | 10/2020 | Kordasiewicz et al. |
| 10,799,523 | B2 | 10/2020 | Olson et al. |
| 11,053,498 | B2 | 7/2021 | Kordasiewicz |
| 11,104,899 | B2 | 8/2021 | Prakash et al. |
| 11,155,815 | B2 | 10/2021 | Rigo |
| 11,162,101 | B2 | 11/2021 | Luzzio et al. |
| 11,473,083 | B2 | 10/2022 | Polydoro Ofengeim et al. |
| 2003/0027780 | A1 | 2/2003 | Hardee et al. |
| 2004/0171570 | A1 | 9/2004 | Allerson et al. |
| 2005/0223427 | A1 * | 10/2005 | Leake ................... C12N 15/111 536/23.1 |
| 2005/0244858 | A1 | 11/2005 | Rossi et al. |
| 2006/0112437 | A1 | 5/2006 | Kontsekova et al. |
| 2007/0292909 | A1 | 12/2007 | Miyawaki et al. |
| 2008/0039618 | A1 | 2/2008 | Allerson et al. |
| 2009/0012281 | A1 | 1/2009 | Swayze et al. |
| 2010/0173973 | A1 | 7/2010 | Brown |
| 2010/0324120 | A1 | 12/2010 | Chen et al. |
| 2011/0313020 | A1 | 12/2011 | Templin et al. |
| 2012/0157511 | A1 | 6/2012 | Manoharan et al. |
| 2013/0011922 | A1 | 1/2013 | Quay et al. |
| 2013/0096289 | A1 | 4/2013 | Wengel |
| 2013/0190383 | A1 | 7/2013 | Vaish et al. |
| 2014/0288158 | A1 | 9/2014 | Rajeev et al. |
| 2014/0315835 | A1 | 10/2014 | Rajeev et al. |
| 2016/0145617 | A1 | 5/2016 | Kordasiewicz et al. |
| 2017/0175116 | A1 | 6/2017 | Polydoro Ofengeim et al. |
| 2017/0211064 | A1 | 7/2017 | Rigo |
| 2017/0275626 | A1 | 9/2017 | Maier et al. |
| 2018/0051283 | A1 | 2/2018 | Rigo |
| 2018/0066254 | A1 | 3/2018 | Covello et al. |
| 2018/0094261 | A1 | 4/2018 | Kordasiewicz et al. |
| 2018/0119145 | A1 | 5/2018 | Kordasiewicz |
| 2018/0119169 | A1 | 5/2018 | Kim et al. |
| 2019/0211332 | A1 | 7/2019 | Kordasiewicz |
| 2021/0207144 | A1 | 7/2021 | Manoharan et al. |
| 2021/0230598 | A1 | 7/2021 | Sobue et al. |
| 2021/0261945 | A1 | 8/2021 | Seth et al. |
| 2022/0090069 | A1 | 3/2022 | Khvorova et al. |
| 2023/0203486 | A1 * | 6/2023 | Soundarapandian ........................ C12N 15/113 514/44 A |

FOREIGN PATENT DOCUMENTS

| | | |
|---|---|---|
| WO | WO 1993/24640 | 12/1993 |
| WO | WO 1994/00569 | 1/1994 |
| WO | WO 1994/02595 | 2/1994 |
| WO | WO 1996/37194 | 11/1996 |
| WO | WO 1996/40964 | 12/1996 |
| WO | WO 1997/13499 | 4/1997 |
| WO | WO 1997/30731 | 8/1997 |
| WO | WO 1998/39359 | 9/1998 |
| WO | WO 1999/14226 | 3/1999 |
| WO | WO 2000/03683 | 1/2000 |
| WO | WO 2000/22114 | 4/2000 |
| WO | WO 2007/091269 | 8/2007 |
| WO | WO 2007/117686 | 10/2007 |
| WO | WO 2008/042973 | 4/2008 |
| WO | WO 2009/014887 | 1/2009 |
| WO | WO 2009/088891 | 7/2009 |
| WO | WO 2009/088892 | 7/2009 |
| WO | WO 2009/127060 | 10/2009 |
| WO | WO 2009/132131 | 10/2009 |
| WO | WO 2010/011895 | 1/2010 |
| WO | WO 2010/054406 | 5/2010 |
| WO | WO 2010/088537 | 8/2010 |
| WO | WO 2010/129709 | 11/2010 |
| WO | WO 2010/141511 | 12/2010 |
| WO | WO 2011/005861 | 1/2011 |
| WO | WO 2011/031520 | 3/2011 |
| WO | WO 2011/133876 | 10/2011 |
| WO | WO 2012/177906 | 12/2012 |
| WO | WO 2013/036868 | 3/2013 |
| WO | 2013/074974 A2 | 5/2013 |
| WO | WO 2013/075035 | 5/2013 |
| WO | WO 2014/179620 | 11/2014 |
| WO | WO 2014/179627 | 11/2014 |
| WO | WO 2015/116658 | 8/2015 |
| WO | 2016/028649 A1 | 2/2016 |
| WO | 2017/109679 A1 | 6/2017 |
| WO | WO 2018/098328 | 5/2018 |
| WO | WO 2019/055633 | 3/2019 |
| WO | WO 2019/217397 | 11/2019 |
| WO | WO 2019/217459 | 11/2019 |
| WO | WO 2019/222479 | 11/2019 |
| WO | WO 2020/097044 | 5/2020 |
| WO | WO 2020/132227 | 6/2020 |
| WO | WO 2021/030522 | 2/2021 |
| WO | WO 2021/087036 | 5/2021 |

(56) References Cited

FOREIGN PATENT DOCUMENTS

| | | | |
|---|---|---|---|
| WO | WO 2021/092371 | | 5/2021 |
| WO | WO 2021/102373 | | 5/2021 |
| WO | WO 2021/113270 | | 6/2021 |
| WO | WO 2021/119226 | | 6/2021 |
| WO | WO 2021/188626 | | 9/2021 |
| WO | WO 2021/207189 | | 10/2021 |
| WO | WO 2021/222065 | | 11/2021 |
| WO | WO 2000/22113 | | 4/2022 |
| WO | 2022/159158 | A1 | 7/2022 |

OTHER PUBLICATIONS

Chernikov et al.,Current Development of siRNA Bioconjugates: From Research to the Clinic, 2019, Frontiers in Pharmacology, 10, 1-25. (Year: 2019).*

Aigner, "Delivery Systems for the Direct Application of siRNAs to Induce RNA Interference (RNAi) In Vivo," J. Biomed. Biotechnol., 2006, 2006:71659, 15 pp.

Akaneya et al., "RNAi-Induced Gene Silencing by Local Electroporation in Targeting Brain Region," J. Neurophysiol., 2005, 93:594-602.

Akhtar & Juliano, "Cellular uptake and intracellular fate of antisense oligonucleotides," Trends Cell. Biol., 1992, 2(5):139-144.

Allen & Chonn, "Large unilamellar liposomes with low uptake into the reticuloendothelial system," Febs Letters, 1987, 223(1):42-46.

Aoki et al., "Potential tumor-targeting peptide vector of histidylated oligolysine conjugated to a tumor-homing RGD motif," Cancer Gene Therapy, 2001, 8(10):783-787.

Arnold et al., "Specific beta1-adrenergic receptor silencing with small interfering RNA lowers high blood pressure and improves cardiac function in myocardial ischemia," J. Hypertens., 2007, 25(1):197-205.

Bangham et al., "Diffusion of Univalent lons Across the Lamellae of Swollen Phospholipids," J. Mol. Biol., 1965, 13:238-252.

Bartel, "MicroRNA Target Recognition and Regulatory Functions," Cell, Jan. 23, 2009, 136(2):215-233.

Bernstein et al., "Role for a bidentate ribonuclease in the initiation step of RNA interference," Nature, 2001, 409:363-366.

Bitko et al., "Inhibition of respiratory viruses by nasally administered siRNA," Nat. Med., 2005, 11:50-55; published online Dec. 26, 2004.

Bonnet et al., "Systemic Delivery of DNA or siRNA Mediated by Linear Polyethylenimine (L-PEI) Does Not Induce an Inflammatory Response," Pharm. Res., 2008, 25(12):2972-2982; Epub Aug. 16, 2008.

Buur et al., "Penetration of 5-Fluorouracil and Prodrugs Across the Intestine of the Albino Rabbit: Evidence for Shift in Absorption Site from the Upper to the Lower Region of the Gastrointestinal Tract by Prodrugs," J. Control Rel., 1990, 14:43-51.

Caillet-Boudin et al., "Regulation of human MAPT gene expression," Mol Neurodegener, 2015, 10:28, 14 pp.

Cepeda et al., "Genetic mouse models of Huntington's disease: focus on electrophysiological mechanisms," ASN Neuro, 2010, 2(2):e00033, 12 pp.

Chien et al., "Novel cationic cardiolipin analogue-based liposome for efficient DNA and small interfering RNA delivery in vitro and in vivo," Cancer Gene Ther., 2005, 12:321-328.

Chu & Rana, "Potent RNAi by short RNA triggers," RNA, 2008, 14:1714-1719.

Constantinides et al., "Formulation and Intestinal Absorption Enhancement Evaluation of Water-in-Oil Microemulsions Incorporating Medium-Chain Glycerides," Pharmaceutical Research, 1994, 11(10):1385-1390.

Couture & Stinchcomb, "Anti-gene therapy: the use of ribozymes to inhibit gene function," Trends in Genetics, 1996, 12(12):510-515.

Crooke et al., "Pharmacokinetic Properties of Several Novel Oligonucleotide Analogs in mice," J. Pharmacol. Exp. Ther., 1996, 277:923-937.

Dobin et al., "STAR: ultrafast universal RNA-seq aligner," Bioinformatics, 2013, 29(1):15-21.

Dorn et al., "siRNA relieves chronic neuropathic pain," Nucleic Acids, 2004, 32:e49, 6 pp.

Du Plessis et al., "Topical delivery of liposomally encapsulated gamma-interferon," Antiviral Research, 1992, 18:259-265.

Elbashir et al., "Functional anatomy of siRNAs for mediating efficient RNAi in *Drosophila melanogaster* embryo lysate," Embo J., 2001, 20(23):6877-6888.

Elbashir et al., "RNA interference is mediated by 21- and 22-nucleotide RNAs," Genes Dev., 2001, 15:188-200.

El-Hariri et al., "The Mitigating Effects of Phosphatidylcholines on Bile Salt- and Lysophosphatidylcholine-induced Membrane Damage," J. Pharm. Pharmacol., 1992, 44:651-654.

Elmén et al., "Locked nucleic acid (LNA) mediated improvements in siRNA stability and functionality," Nucleic Acids Research, 2005, 33(1):439-447.

Felgner et al., "Lipofection: A highly efficient, lipid-mediated DNA-transfection procedure," Proc. Natl. Acad. Sci. USA, 1987, 84:7413-7417.

Felgner et al., "Enhanced Gene Delivery and Mechanism Studies with a Novel Series of Cationic Lipid Formulations," J. Biol. Chem., 1994, 269(4):2550-2561.

Fluiter et al., "Filling the gap in LNA antisense oligo gapmers: the effects of unlocked nucleic acid (UNA) and 4'-C-hydroxymethyl-DNA modifications on RNase H recruitment and efficacy of an LNA gapmer," Mol. Biosyst., 2009, 5:838-843.

Fukunaga et al., "Liposome Entrapment Enhances the Hypocalcemic Action of Parenterally Administered Calcitonin," Endocrinol., 1984, 115(2):757-761.

Gabizon & Papahadjopoulos, "Liposome formulations with prolonged circulation time in blood and enhanced uptake by tumors," Proc. Natl. Acad. Sci. USA, 1988, 85:6949-6953.

Gao et al, "A Novel Cationic Liposome Reagent for Efficient Transfection of Mammalian Cells," Biochim. Biophys. Res. Commun., 1991, 179(1):280-285.

Gassmann et al., "Maintenance of an extrachromosomal plasmid vector in mouse embryonic stem cells," Proc. Natl. Acad. Sci. USA, 1995, 92:1292-1296.

GenBank NCBI Reference Sequence: NC_000017.11, "*Homo sapiens* chromosome 17, GRCh38.p14 Primary Assembly," Oct. 7, 2023.

GenBank NCBI Reference Sequence: NG_007398.2, "*Homo sapiens* microtubule associated protein tau (MAPT), RefSeqGene (LRG_660) on chromosome 17," Feb. 15, 2023.

GenBank NCBI Reference Sequence: NM_001038609.2, "Mus musculus microtubule-associated protein tau (Mapt), transcript variant 1, mRNA," Mar. 12, 2022.

GenBank NCBI Reference Sequence: NM_005910.6, "*Homo sapiens* microtubule associated protein tau (MAPT), transcript variant 2, mRNA," Nov. 20, 2023.

GenBank NCBI Reference Sequence: NM_016841.4, "*Homo sapiens* microtubule associated protein tau (MAPT), transcript variant 4, mRNA," May 14, 2019.

GenBank NCBI Reference Sequence: XM_005584540.1, "Predicted: Macaca fascicularis microtubule associated protein tau (MAPT), transcript variant X13, mRNA," Jan. 25, 2016.

GenBank NCBI Reference Sequence: XM_005624183.3, "Predicted: Canis lupus familiaris microtubule associated protein tau (MAPT), transcript variant X23, mRNA," Sep. 5, 2017.

GenBank NCBI Reference Sequence: XM_008768277.2, "Predicted: Rattus norvegicus microtubule-associated protein tau (Mapt), transcript variant X7, mRNA," Jul. 26, 2016.

Gershon et al., "Mode of Formation and Structural Features of DNA-Cationic Liposome Complexes Used for Transfection," Biochem., 1993, 32:7143-7151.

Grünweller et al., "Comparison of different antisense strategies in mammalian cells using locked nucleic acids, 2'-O-methyl RNA, phosphorothioates and small interfering RNA," Nucleic Acids Research, 2003, 31(12):3185-3193.

Guatelli et al., "Isothermal, in vitro amplification of nucleic acids by a multienzyme reaction modeled after retroviral replication," Proc. Natl. Acad. Sci. USA, 1990, 87:1874-1878.

(56) References Cited

OTHER PUBLICATIONS

Haubner et al., "Glycosylated RGD-Containing Peptides: Tracer for Tumor Targeting and Angiogenesis Imaging with Improved Biokinetics," J Nucl Med, 2001, 42:326-336.
Hefti et al., "High-resolution temporal and regional mapping of MAPT expression and splicing in human brain development," PLoS One, 2018, 13(4):e0195771, 14 pp.
Ho et al., "Preparation of Microemulsions Using Polyglycerol Fatty Acid Esters as Surfactant for the Delivery of Protein Drugs," J. Pharm. Sci., 1996, 85(2):138-143.
Howard et al., "RNA Interference in Vitro and in Vivo Using a Chitosan/siRNA Nanoparticle System," Mol. Ther., 2006, 14(4):476-484.
Hu et al., "Topical delivery of cyclosporin A from non-ionic liposomal systems : an in vivo/in vitro correlation study using hairless mouse skin," S.T.P. Pharma. Sci., 1994, 4(6):466-469.
Itani et al., "A simple and efficient liposome method for transfection of DNA into mammalian cells grown in suspension," Gene, 1987, 56:267-276.
Jarrett, "Affinity chromatography with nucleic acid polymers," Chromatogr., 1993, 618:315-339.
Jensen et al., "Unlocked nucleic acid (UNA) and UNA derivatives: Thermal denaturation studies," Nuc. Acids Symp. Series, 2008, 52(1):133-134.
Kabanov et al., "A new class of antivirals: antisense oligonucleotides combined with a hydrophobic substituent effectively inhibit influenza virus reproduction and synthesis of virus-specific proteins in MDCK cells," Febs Lett., 1990, 259(2):327-330.
Kim et al., "Preparation of Multivesicular Liposomes," Biochim. Biophys. Acta, 1983, 728:339-348.
Kim et al., "Synthetic dsRNA Dicer substrates enhance RNAi potency and efficacy," Nat Biotech, 2005, 23(2):222-226.
Kim et al., "Cholesteryl Oligoarginine Delivering Vascular Endothelial Growth Factor siRNA Effectively Inhibits Tumor Growth in Colon Adenocarcinoma," Mol. Ther., 2006, 14(3):343-350.
Kim et al., "Local and systemic delivery of VEGF siRNA using polyelectrolyte complex micelles for effective treatment of cancer," Journal of Controlled Release, 2008, 129:107-116.
Kubo et al., "Chemically modified symmetric and asymmetric duplex RNAs: an enhanced stability to nuclease degradation and gene silencing effect," Biochem. Biophys. Res. Comm., 2008, 365:54-61; available online Oct. 29, 2007.
Kwoh et al., "Transcription-based amplification system and detection of amplified human immunodeficiency virus type 1 with a bead-based sandwich hybridization format," Proc. Natl. Acad. Sci. USA, 1989, 86:1173-1177.
Lam et al., "A new type of synthetic peptide library for identifying ligand-binding activity," Nature, 1991, 354:82-84.
Lee et al., "Mucosal Penetration Enhancers For Facilitation of Peptide and Protein Drug Absorption," Critical Reviews in Therapeutic Drug Carrier Systems, 1991, 8(2):91-192.
Letsinger et al., "Cholesteryl-conjugated oligonucleotides: Synthesis, properties, and activity as inhibitors of replication of human immunodeficiency virus in cell culture," Proc. Natl. Acid. Sci. USA, 1989, 86:6553-6556.
Li et al., "Polyethylenimine-complexed Plasmid Particles Targeting Focal Adhesion Kinase Function as Melanoma Tumor Therapeutics," Mol. Ther., 2007, 15(3):515-523.
Liao et al., "featureCounts: an efficient general purpose program for assigning sequence reads to genomic features," Bioinformatics, Apr. 1, 2014, 30(7):923-930.
Lim et al., "Cell-based Models to Investigate Tau Aggregation," Comput Struct Biotechnol J, 2014, 12:7-13.
Lima et al., "Single-Stranded siRNAs Activate RNAi in Animals," Cell, 2012, 150:883-894.
Liu, "Radiolabeled Multimeric Cyclic RGD Peptides as Integrin $\alpha v\beta 3$ Targeted Radiotracers for Tumor Imaging," Mol. Pharm., 2006, 3(5):472-487.
Lizardi et al., "Exponential Amplification of Recombinant-RNA Hybridization Probes," Bio/Technology, 1988, 6:1197-1202.
Love et al., "Moderated estimation of fold change and dispersion for RNA-seq data with DESeq2," Genome Biol. 2014;15(12):550, 21 pp.
Makimura et al., "Reducing hypothalamic AGRP by RNA interference increases metabolic rate and decreases body weight without influencing food intake," BMC Neurosci., 2002, 3:18, 6 pp.
Mannino & Gould-Fogerite, "Liposome Mediated Gene Transfer," Biotechniques, 1988, 6(7):682-690.
Manoharan et al., "Chemical Modifications to Improve Uptake and Bioavailability of Antisense Oligonucleotides," Ann. N.Y. Acad. Sci., 1992, 660:306-309.
Manoharan et al., "Introduction of a Lipophilic Thioether Tether in the Minor Groove of Nucleic Acids for Antisense Applications," Biorg. Med. Chem. Let., 1993, 3(12):2765-2770.
Manoharan et al., "Cholic Acid-Oligonucleotide Conjugates for Antisense Applications," Biorg. Med. Chem. Let., 1994, 4(8):1053-1060.
Manoharan et al., "Lipidic Nucleic Acids," Tetrahedron Lett., 1995, 36(21):3651-3654.
Manoharan et al., "Oligonucleotide Conjugates: Alteration of the Pharmacokinetic Properties of Antisense Agents," Nucleosides & Nucleotides, 1995, 14(3-5):969-973.
Martin et al., "A New Access to 2'-O-alkylated Ribonucleosides and Properties of 2'-O-Alkylated Oligoribonucleotides," Helv. Chim. Acta, 1995, 78:486-504 (including machine translation).
Mayer et al., "Vesicles of variable sizes produced by a rapid extrusion procedure," Biochim. Biophys. Acta, 1986, 858:161-168.
Mayhew et al., "Characterization of Liposomes Prepared by Using a Microemulsifier," Biochim. Biophys. Acta, 1984, 775:169-174.
McNamara et al., "Cell type-specific delivery of siRNAs with aptamer-siRNA chimeras," Nat. Biotechnol., 2006, 24(8):1005-1015.
Mikhailov et al., "Synthesis of a New Class of Acyclic 2',5'- and 3',5'-Oligonucleotide Analogs Based on 9-[1,5-dihydroxy-4(S)-hydroxymethyl-3-oxapent-2(R)-yl]-adenine," Tetrahedron Letters, 1985, 26(17):2059-2062.
Mishra et al., "Improved leishmanicidal effect of phosphorotioate antisense oligonucleotides by LDL-mediated delivery," Biochim. Biophys. Acta, 1995, 1264:229-237.
Mook et al., "Evaluation of locked nucleic acid-modified small interfering RNA in vitro and in vivo," Mol Canc Ther, 2007, 6(3):833-843.
Muranishi, "Absorption Enhancers," Critical Reviews in Therapeutic Drug Carrier Systems, 1990, 7(1):1-33.
Nabel et al., "Gene Transfer In Vivo with DNA-Liposome Complexes: Lack of Autoimmunity and Gonadal Localization," Human Gene Ther., 1992, 3:649-656.
Nabel et al., "Direct gene transfer wit DNA-liposome complexes in melanoma: Expression, biologic activity, and lack of toxicity in humans," Proc. Natl. Acad. Sci. USA, 1993, 90:11307-11311.
NCBI Gene ID: 4137, "MAPT microtubule associated protein tau [ *Homo sapiens* (human) ]," Nov. 28, 2023.
Nicolau et al., "Liposomes as Carriers for in Vivo Gene Transfer and Expression," Meth. Enzymol., 1987, 149:157-176.
Nielsen et al., "Sequence-Selective Recognition of DNA by Strand Displacement with a Thymine-Substituted Polyamide," Science, 1991, 254(5037):1497-1500.
Nykänen et al., "ATP Requirements and Small Interfering RNA Structure in the RNA Interference Pathway," Cell, 2001, 107(3):309-321.
Oberhauser & Wagner, "Effective incorporation of 2'-O-methyl-oligoribonucleotides into liposomes and enhanced cell association through modification with thiocholesterol," Nucl. Acids Res., 1992, 20(3):533-538.
Olson et al., "Preparation of liposomes of defined size distribution by extrusion through polycarbonate membranes," Biochim. Biophys. Acta, 1979, 557(1):9-23.
Pal et al., "Systemic delivery of RafsiRNA using cationic cardiolipin liposomes silences Raf-1 expression and inhibits tumor growth in xenograft model of human prostate cancer," Int J. Oncol., 2005, 26:1087-1091.
Papahadjopoulos & Gabizon, "Targeting of Liposomes to Tumor Cells in Vivo," Ann. N.Y. Acad. Sci., 1987, 507(1):64-74.

(56) References Cited

OTHER PUBLICATIONS

Pillé et al., "Anti-RhoA and Anti-RhoC siRNAs Inhibit the Proliferation and Invasiveness of MDA-MB-231 Breast Cancer Cells in Vitro and in Vivo," Mol. Ther., 2005, 11(2):267-274.
Pouladi et al., "Choosing an animal model for the study of Huntington's disease," Nat Rev Neurosci, 2013, 14(10):708-21, doi:10.1038/nrn3570, 52 pp.
Reich et al., "Small interfering RNA (siRNA) targeting VEGF effectively inhibits ocular neovascularization in a mouse model," Mol. Vis., 2003, 9:210-216.
Ritschel, "Microemulsions for Improved Peptide Absorption from the Gastrointestinal Tract," Meth. Find. Exp. Clin. Pharmacol., 1991, 13(3):205-220.
Rubenstein et al., "A Novel, Ultrasensitive Assay for Tau: Potential for Assessing Traumatic Brain Injury in Tissues and Biofluids," J. Neurotrauma, Mar. 1, 2015, 32:342-352.
Saison-Behmoaras et al., "Short modified antisense oligonucleotides directed against Ha-ras point mutation induce selective cleavage of the mRNA and inhibit T24 cells proliferation," Embo J, 1991, 10(5): 1111-1118
Sharp, "RNA interference—2001," Genes Dev., 2001, 15:485-490.
Shea et al., "Synthesis, hybridization properties and antiviral activity of lipid-oligodeoxynucleotide conjugates," Nucl. Acids Res., 1990, 18(13):3777-3783.
Shishkina et al., "Attenuation of α2A-Adrenergic Receptor Expression in Neonatal Rat Brain by RNA Interference or Antisense Oligonucleotide Reduced Anxiety in Adulthood," Neuroscience, 2004, 129:521-528.
Simeoni et al., "Insight into the mechanism of the peptide-based gene delivery system MPG: implications for delivery of siRNA into mammalian cells," Nucl. Acids Res., 2003, 31(11):2717-2724.
Sørensen et al., "Gene Silencing by Systemic Delivery of Synthetic siRNAs in Adult Mice," J. Mol. Biol., 2003, 327:761-766.
Soutschek et al., "Therapeutic silencing of an endogenous gene by systemic administration of modified siRNAs," Nature, 2004, 432:173-178.
Straubinger & Papahadjopoulos, "Liposomes as Carriers for Intracellular Delivery of Nucleic Acids," Meth. Enzymol., 1983, 101:512-527.
Strauss & Jaenisch, "Molecular complementation of a collagen mutation in mammalian cells using yeast artificial chromosomes," Embo J., 1992, 11(2):417-422.
Svinarchuk et al., "Inhibition of HIV proliferation in MT-4 cells by antisense oligonucleotide conjugated to lipophilic groups," Biochimie, 1993, 75:49-54.
Szoka & Papahadjopoulos, "Procedure for preparation of liposomes with large internal aqueous space and high capture by reverse-phase evaporation," Proc. Natl. Acad. Sci., 1978, 75(9):4194-4198.
Takahashi et al., "The Use of a Perfluorochemical Emulsion as a Vascular Perfusate in Drug Absorption," J. Pharm. Pharmacol., 1988, 40:252-257.
Tan et al., "Gene knockdown with intrathecal siRNA of NMDA receptor NR2B subunit reduces formalin-induced nociception in the rat," Gene Ther., 2005, 12:59-66.
Tetko et al., "Prediction of n-Octanol/Water Partition Coefficients from PHYSPROP Database Using Artificial Neural Networks and E-State Indices," J. Chem. Inf. Comput. Sci., 2001, 41:1407-1421.
Thakker et al., "Neurochemical and behavioral consequences of widespread gene knockdown in the adult mouse brain by using nonviral RNA interference," Proc. Natl. Acad. Sci. U.S.A., 2004, 101(49):17270-17275.
Tolentino et al., "Intravitreal Injection of Vascular Endothelial Growth Factor Small Interfering RNA Inhibits Growth and Leakage in a Nonhuman Primate, Laser-Induced Model of Choroidal Neovascularization," Retina, 2004, 24(1):132-138.
Tomalia et al., "Dendrimers as multi-purpose nanodevices for oncology drug delivery and diagnostic imaging," Biochem. Soc. Trans., 2007, 35(1):61-67.
Verma et al., "Small Interfering RNAs Directed against -Catenin Inhibit the in Vitro and in Vivo Growth of Colon Cancer Cells," Clin. Cancer Res., 2003, 9:1291-1300.
Wang & Huang, "pH-sensitive immunoliposomes mediate target-cell-specific delivery and controlled expression of a foreign gene in mouse," Proc. Natl Acad. Sci. USA, 1987, 84:7851-7855.
Wang & Huang, "Plasmid DNA Adsorbed to pH-sensitive Liposomes Efficiently Transforms the Target Cells," Biochem. Biophys. Res. Commun., 1987, 147(3):980-985.
Weiner et al., "Liposomes: A Novel Topical Delivery System for Pharmaceutical and Cosmetic Applications," Journal of Drug Targeting, 1994, 2:405-410.
Wu et al., "Increased Microvascular Permeability Contributes to Preferential Accumulation of Stealth Liposomes in Tumor Tissue," Cancer Research, 1993, 53:3765-3770.
Yamamoto et al., "A Mechanistic Study on Enhancement of Rectal Permeability to Insulin in the Albino Rabbit," J. Pharm. Exp. Ther., 1992, 263(1):25-31.
Yamashita et al., "Effects of diclofenac sodium and disodium ethylenediaminetetraacetate on electrical parameters of the mucosal membrane and their relation to the permeability enhancing effects in the rat jejunum," J. Pharm. Pharmacol., 1987, 39:621-626.
Yamashita et al., "Effect of Adjuvants on Charge-Selective Permeability and Electrical Resistance of Rat Jejunal Membrane," J. Pharm. Sci., 1990, 79(7):579-583.
Yoo et al., "PAMAM Dendrimers as Delivery Agents for Antisense Oligonucleotides," Pharm. Res., 1999, 16:1799-1804.
Zhang et al., "Small Interfering RNA Targeting Heme Oxygenase-1 Enhances Ischemia-Reperfusion-induced Lung Apoptosis," J. Biol. Chem., 2004, 279(11):10677-10684.
Zhou et al., "Lipophilic polylysines mediate efficient DNA transfection in mammalian cells," Biochim. Biophys. Acta, 1991, 1065:8-14.
Zhou & Huang, "Targeted delivery of DNA by liposomes and polymers," Journal of Controlled Release, 1992, 19:269-274.
Zhou et al., "Fine Tuning of Electrostatics around the Internucleotidic Phosphate through Incorporation of Modified 2',4'-Carbocyclic-LNAs and -ENAs Leads to Significant Modulation of Antisense Properties," J. Org. Chem., 2009, 74:118-134.
Zimmermann et al., "RNAi-mediated gene silencing in non-human primates," Nature, 2006, 441:111-114.
Zitzmann et al., "Arginine-glycine-aspartic acid (RGD)-peptide binds to both tumor and tumor endothelial cells in vivo.," Cancer Res., 2002, 62:5139-5143.
International Search Report and Written Opinion issued Mar. 22, 2023 in PCT/US2022/076979.
Egli and Manoharan, "Re-Engineering RNA Molecules into Therapeutic Agents," Acc. Chem. Res., 2019, 52:1036-1047.
Foster et al., "Advanced siRNA Designs Further Improve In Vivo Performance of GalNAc-siRNA Conjugates," Mol. Therapy, 2018, 26(3): 708-717.
Parmar et al., "5' -(E)-Vinylphosphonate: A Stable Phosphate Mimic Can Improve the RNAi Activity of siRNA- GalNAc Conjugates," ChemBioChem, 2016, 17:985-989.
Schlegel et al., "Chirality Dependent Potency Enhancement and Structural Impact of Glycol Nucleic Acid Modification on siRNA," J. Am. Chem. Soc., 2017, 139:8537-8546.
Schlegel et al., "Overcoming GNA/RNA base-pairing limitations using isonucleotides improves the pharmacodynamic activity of ESC+ GalNAc-siRNAs," Nucl. Acids. Res., 2021, 49(19): 10851-10867.
Schlegel et al., "From bench to bedside: Improving the clinical safety of GalNAc-siRNA conjugates using seed- pairing destabilization," Nucl. Acids Res., 2022, 50(12):6656-6670.

* cited by examiner

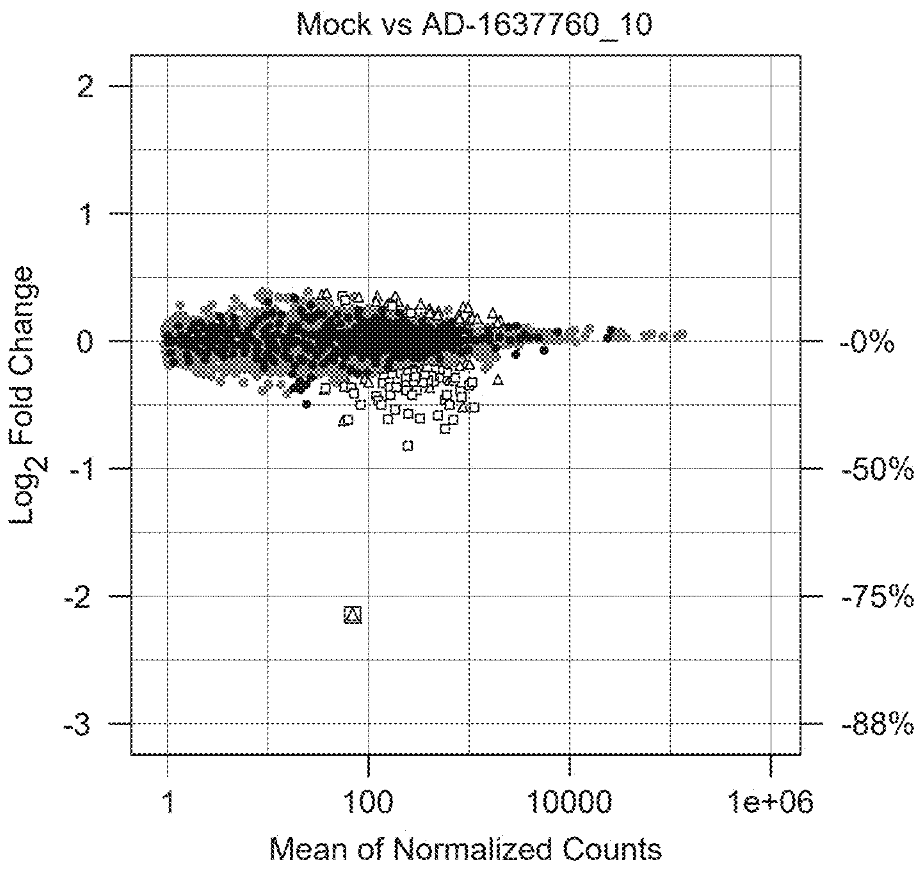
FIG. 2A1
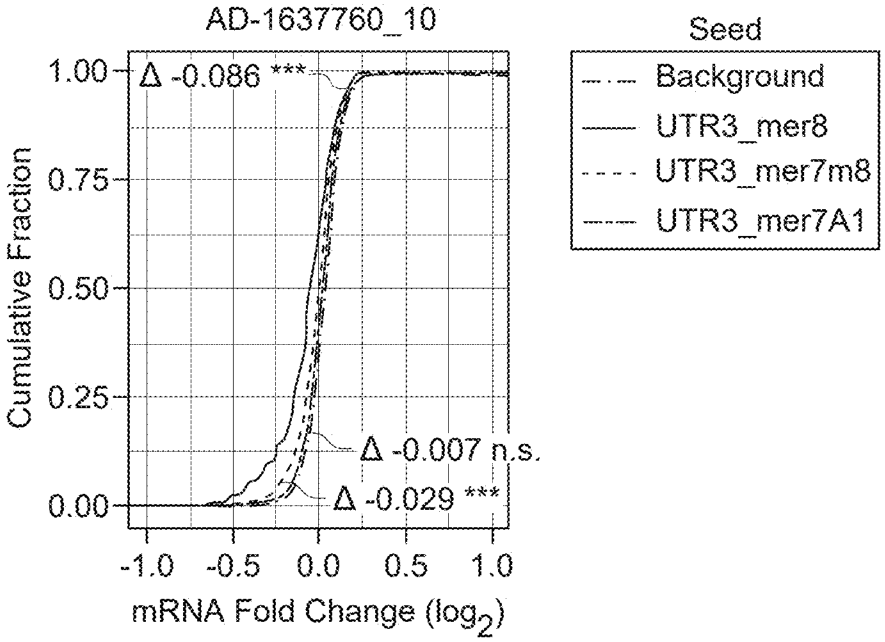
FIG. 2A2

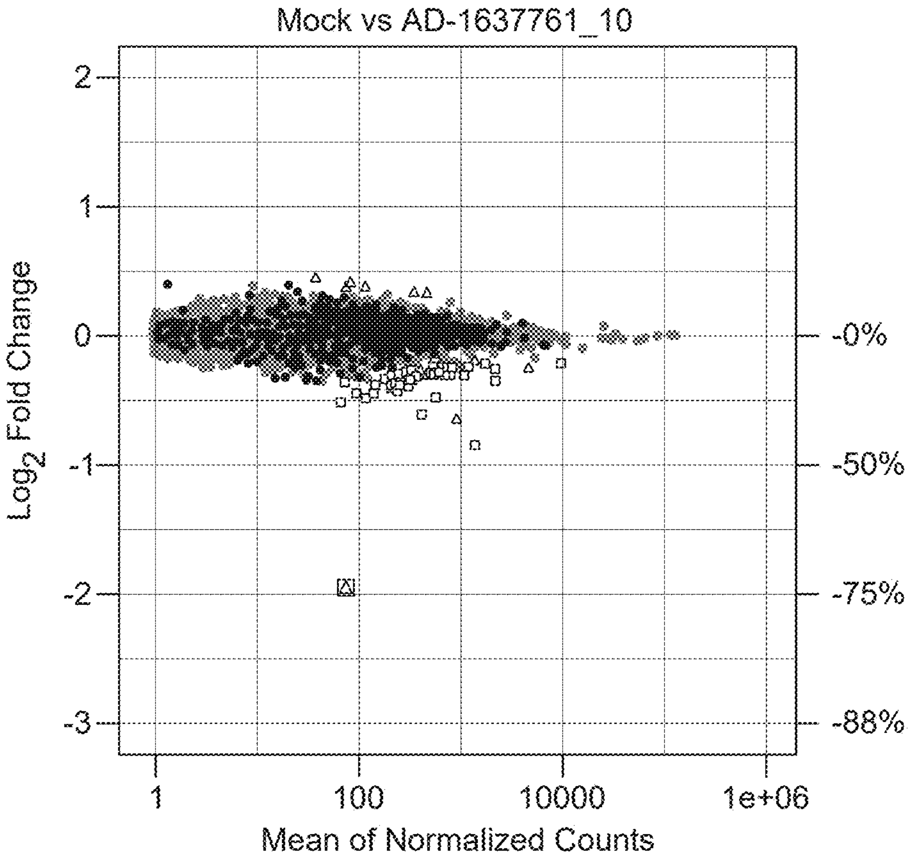
FIG. 2A3
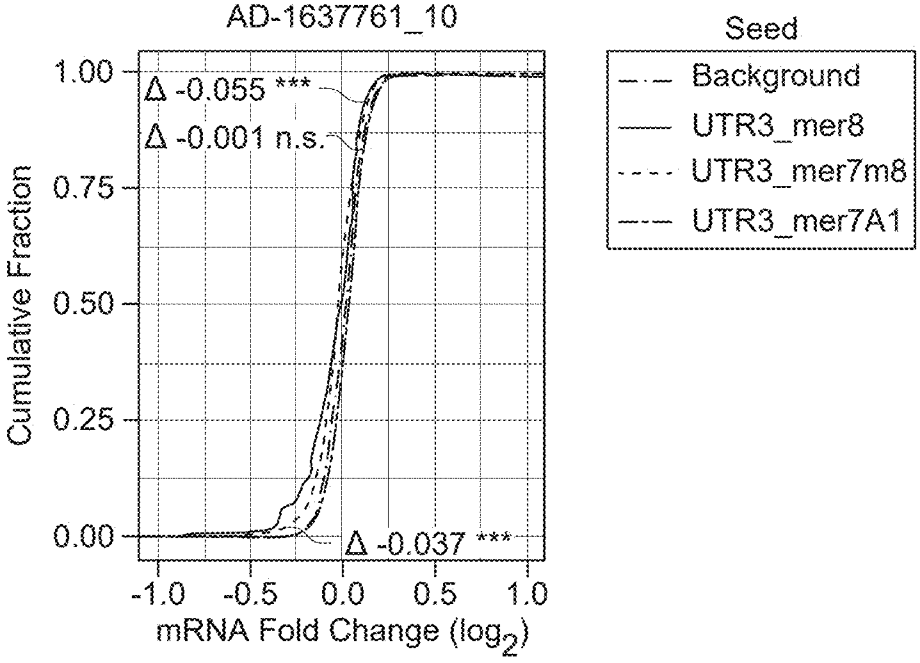
FIG. 2A4

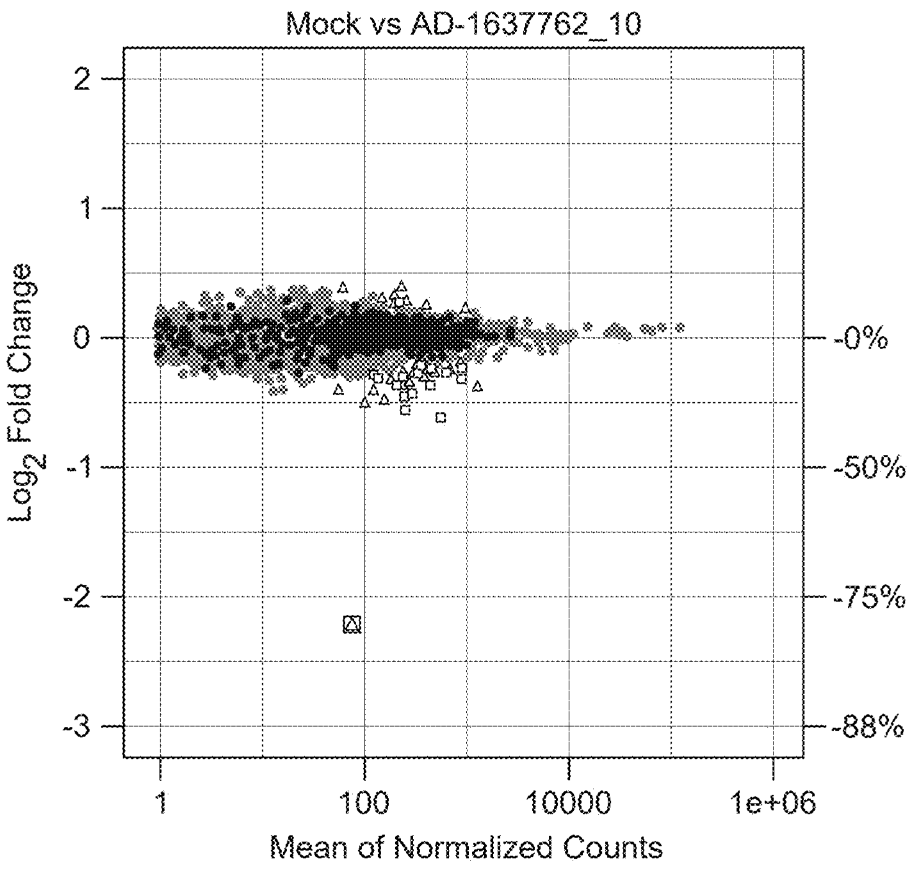
FIG. 2A5
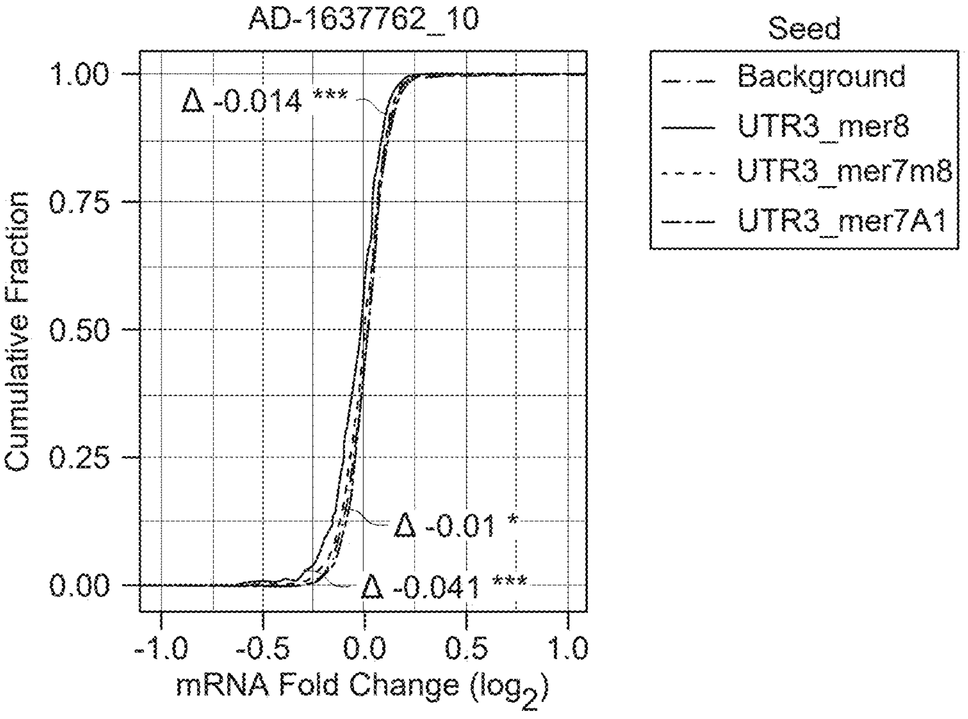
FIG. 2A6

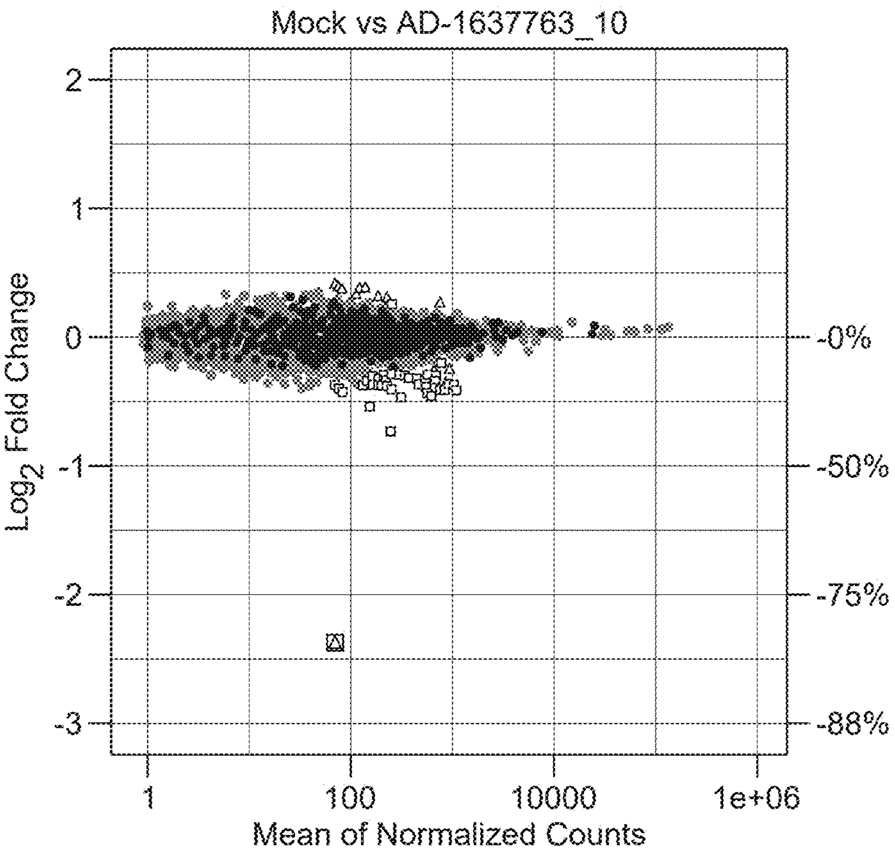
FIG. 2B1
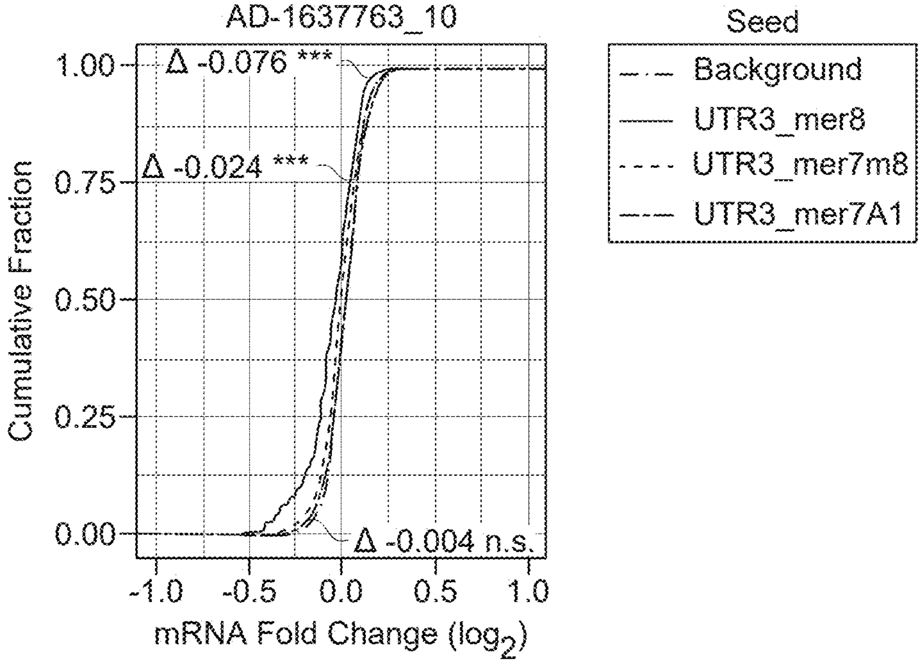
FIG. 2B2

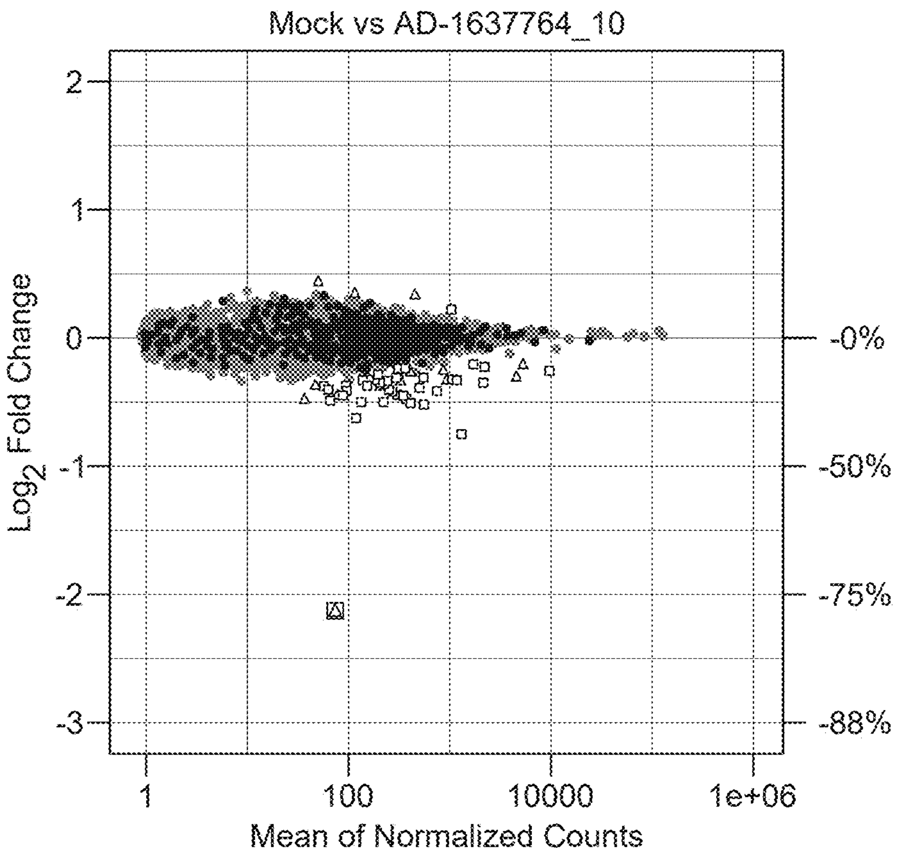
FIG. 2B3
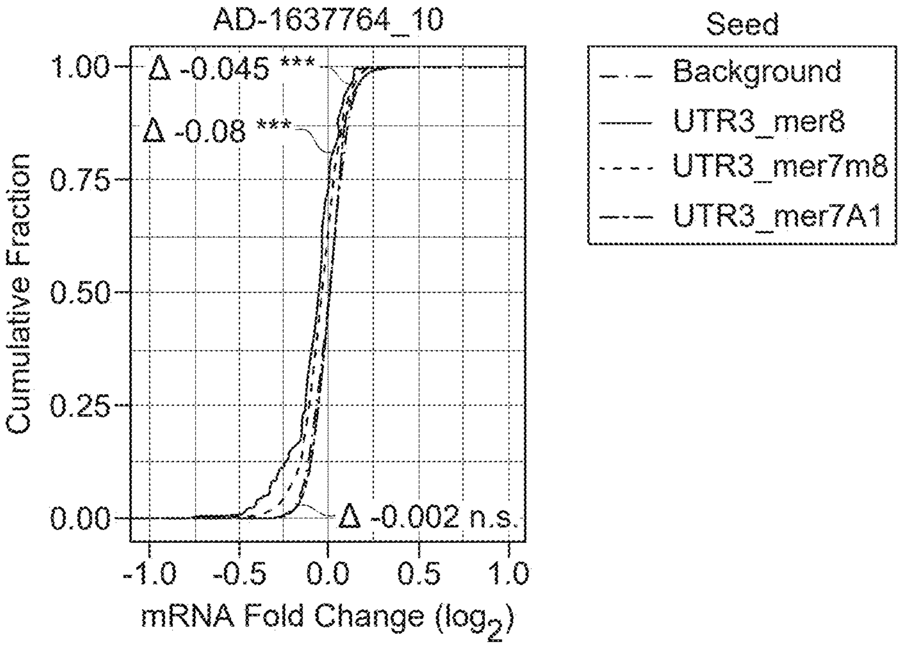
FIG. 2B4

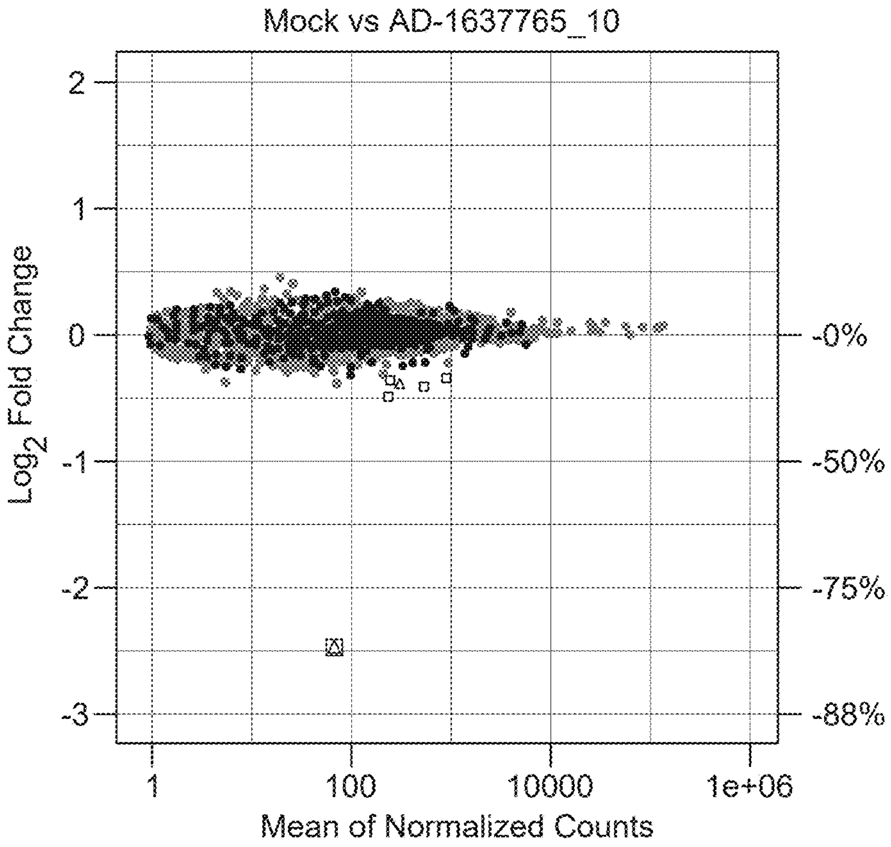
FIG. 2B5
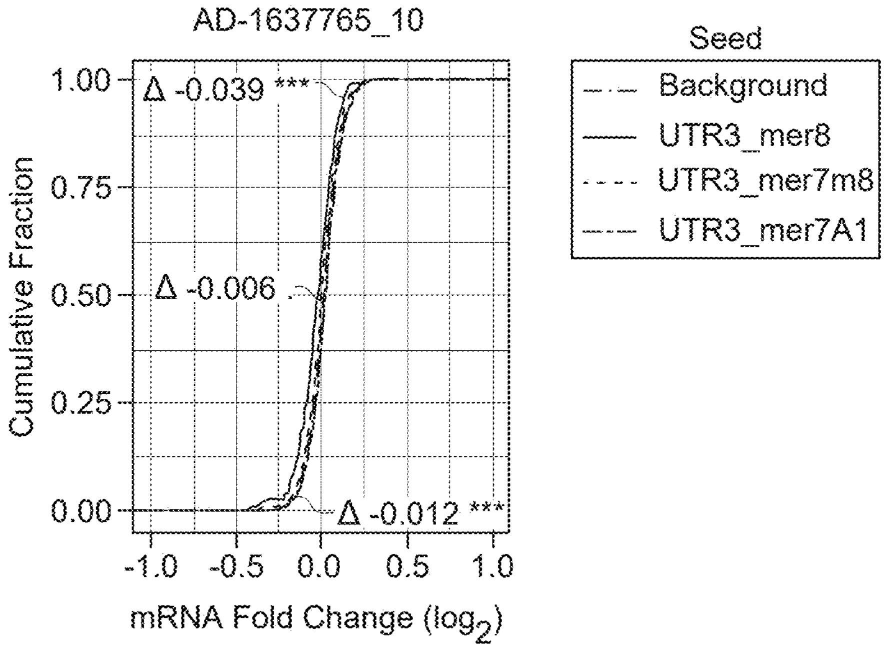
FIG. 2B6

MICROTUBULE ASSOCIATED PROTEIN TAU (MAPT) iRNA AGENT COMPOSITIONS AND METHODS OF USE THEREOF

CROSS-REFERENCE TO RELATED APPLICATIONS

This application is a track one continuation application of International Application No. PCT/US2022/076979 filed Sep. 23, 2022, which claims the benefit of priority to U.S. Provisional Application No. 63/248,119, filed on Sep. 24, 2021, U.S. Provisional Application No. 63/321,573, filed on Mar. 18, 2022, and U.S. Provisional Application No. 63/403,327, filed on Sep. 2, 2022. Each of the foregoing applications is incorporated herein by reference in its entirety.

SEQUENCE LISTING

The instant application contains a Sequence Listing which has been submitted electronically in XML format and is hereby incorporated by reference in its entirety. The XML copy, created on Nov. 11, 2022, is named A108868_1310WO_SL.xml and is 7,900,796 bytes in size.

BACKGROUND OF THE INVENTION

The microtubule associated protein tau (MAPT) gene encoding the protein Microtubule-Associated Protein Tau (Mapt), a member of the microtubule-associated protein family, is located in the chromosomal region 17q21.31 (base pairs 45,894,382 to 46,028,334 on chromosome 17). The MAPT gene consists of 16 exons. Within the central nervous system (CNS), alternative mRNA splicing gives rise to six MAPT isoforms with a total of 352-441 amino acids. In three of the six MAPT isoforms, the microtubule-binding domain of MAPT contains three repeated segments, whereas the corresponding domain contains four repeated segments in the other three MAPT isoforms.

MAPT transcripts are differentially expressed throughout the body, predominantly in the central and peripheral nervous systems. Wild type Tau is involved in stabilizing microtubules in neuronal axons, maintaining dendric spines, and regulating axonal transport, microtubule dynamics, and cell division. Pathogenic variants of MAPT are found in approximately 10% of patients with primary tauopathy. Variants are primarily missense mutations and localized in exons 9-13 (microtubule binding domains), with many affecting the alternative splicing of exon 10.

Tauopathies are a heterogeneous class of progressive neurodegenerative disorders pathologically characterized by the presence of Tau aggregates in the brain. Phenotypically, tauopathies show variable progression of motor, cognitive, and behavioral impairment. Tauopathies include, but are not limited to, Alzheimer's disease, frontotemporal dementia (FTD), and progressive supranuclear palsy (PSP). Tau is the major component of neurofibrillary tangles in the neuronal cytoplasm, a hallmark in Alzheimer's disease. The aggregation and deposition of Tau were also observed in approximately 50% of the brains of patients with Parkinson's disease.

FTD includes, but is not limited to, behavioral variant frontotemporal dementia (bvFTD), nonfluent variant primary progressive aphasia (nfvPPA), and corticobasal syndrome (CBS).

There are currently no curative therapies for tauopathies, and treatments are only aimed at alleviating the symptoms and improving the patient's quality of life. Accordingly, there is a need for agents that selectively and efficiently inhibit or adjust the expression of the MAPT gene such that subjects having a MAPT-associated disorder, e.g., Alzheimer's disease, FTD, PSP, or another tauopathy, is effectively treated.

BRIEF SUMMARY OF THE INVENTION

The present disclosure provides RNAi compositions, which effect the RNA-induced silencing complex (RISC)-mediated cleavage of RNA transcripts of a MAPT gene. The MAPT gene may be within a cell, e.g., a cell within a subject, such as a human. The use of these iRNAs enables the targeted degradation of mRNAs of the corresponding gene (MAPT gene) in mammals.

The iRNAs of the invention have been designed to target a MAPT gene, e.g., a MAPT gene having a missense and/or deletion mutations in the exons of the gene, and having a combination of nucleotide modifications. The iRNAs of the invention inhibit the expression of the MAPT gene by at least about 25%, at least about 30%, at least about 40%, at least about 50%, at least about 60%, at least about 70%, at least about 80%, at least about 90%, or at least about 95%, relative to control levels, and reduce the level of sense- and antisense-containing foci. Without intending to be limited by theory, it is believed that a combination or sub-combination of the foregoing properties and the specific target sites, or the specific modifications in these iRNAs confer to the iRNAs of the invention improved efficacy, stability, potency, durability, and safety.

In one aspect, the present invention provides a double stranded ribonucleic acid (dsRNA) agent for inhibiting expression of MAPT, wherein the dsRNA agent comprises a sense strand and an antisense strand forming a double stranded region, wherein the sense strand comprises at least 15 contiguous nucleotides differing by no more than 3 nucleotides from the nucleotide sequence of SEQ ID NO: 1, and the antisense strand comprises at least 15 contiguous nucleotides differing by no more than 3 nucleotides from the nucleotide sequence of SEQ ID NO: 2.

In one aspect, the present invention provides a double stranded ribonucleic acid (dsRNA) agent for inhibiting expression of MAPT, wherein the dsRNA agent comprises a sense strand and an antisense strand forming a double stranded region, wherein the sense strand comprises at least 15 contiguous nucleotides differing by no more than 3 nucleotides from the nucleotide sequence of SEQ ID NO: 3, and the antisense strand comprises at least 15 contiguous nucleotides differing by no more than 3 nucleotides from the nucleotide sequence of SEQ ID NO: 4.

In another aspect, the present invention provides a dsRNA agent for inhibiting expression of MAPT, wherein the dsRNA agent comprises a sense strand and an antisense strand forming a double stranded region, wherein the antisense strand comprises a region of complementarity to an mRNA encoding Tau, and wherein the region of complementarity comprises at least 15 contiguous nucleotides differing by no more than 3 nucleotides from the nucleotide sequence of SEQ ID NO: 2.

In another aspect, the present invention provides a dsRNA agent for inhibiting expression of MAPT, wherein the dsRNA agent comprises a sense strand and an antisense strand forming a double stranded region, wherein the antisense strand comprises a region of complementarity to an mRNA encoding Tau, and wherein the region of complementarity comprises at least 15 contiguous nucleotides differing by no more than 3 nucleotides from the nucleotide sequence of SEQ ID NO: 4.

In yet another aspect, the present invention provides a dsRNA agent for inhibiting expression of MAPT, wherein the dsRNA agent comprises a sense strand and an antisense strand forming a double stranded region, wherein the antisense strand comprises a region of complementarity to an mRNA encoding Tau, and wherein the region of complementarity comprises at least 15 contiguous nucleotides differing by no more than 3 nucleotides from any one of the antisense nucleotide sequences in any one of Tables 3-6.

In one embodiment, the sense strand comprises at least 15 contiguous nucleotides differing by no more than three nucleotides from any one of the nucleotide sequence of nucleotides 506-526, 507-527, 508-528, 509-529, 510-530, 511-531, 512-532, 513-533, 514-534, 515-535, 516-536, 517-537, 518-538, 519-539, 520-540, 521-541, 522-542, 523-543, 524-544, 525-545, 526-544, 526-546, 527-547, 528-548, 529-549, 530-550, 531-551, 532-552, 533-553, 969-989, 970-990, 971-991, 972-992, 973-993, 974-994, 975-995, 976-996, 977-997, 978-997, 978-998, 979-997, 979-999, 980-1000, 981-1001, 982-1002, 983-1003, 984-1004, 985-1003, 985-1005, 986-1006, 987-1007, 988-1008, 989-1009, 990-1010, 1069-1089, 1070-1090, 1071-1091, 1072-1092, 1073-1093, 1074-1094, 1075-1095, 1076-1096, 1077-1095, 1077-1097, 1078-1098, 1079-1099, 1080-1100, 1081-1101, 5511-5531, 5512-5532, 5513-5533, 5514-5534, 5515-5535, 5516-5536, 5517-5537, 5518-5538, 5519-5539, 5520-5540, 5521-5541, 5522-5542, and 5523-5543 of SEQ ID NO: 1, and the antisense strand comprises at least 15 contiguous nucleotides from the corresponding nucleotide sequence of SEQ ID NO: 2.

In one embodiment, the sense strand comprises at least 15 contiguous nucleotides differing by no more than three nucleotides from any one of the nucleotide sequence of nucleotides 1072-1092, 1067-1087, and 514-534 of SEQ ID NO: 3, and the antisense strand comprises at least 15 contiguous nucleotides from the corresponding nucleotide sequence of SEQ ID NO: 4. In one embodiment, the antisense strand comprises at least 15 contiguous nucleotides differing by no more than three nucleotides from any one of the antisense strand nucleotide sequences of a duplex selected from the group consisting of AD-1397070, AD-1397072, AD-1397073, AD-1397075, AD-1397081, AD-1397083, AD-1397088, AD-1397249, AD-1397252, AD-1397253, AD-1397258, AD-1397261, AD-1397262, AD-1397263, AD-1397291, AD-1397293, AD-1397294, AD-1397295, AD-1397298, AD-1397299, AD-1637732, AD-1637733, AD-1637734, AD-1637735, AD-1637736, AD-1637737, AD-1637739, AD-1637744, AD-1637745, AD-1637746, AD-1637747, AD-1637748, AD-1637749, AD-1637750, AD-1637751, AD-1637752, AD-1637753, AD-1637754, AD-1637755, AD-1637756, AD-1637757, AD-1637758, AD-1637759, AD-1637760, AD-1637761, AD-1637762, AD-1637763, AD-1637764, AD-1637765, AD-1637766, AD-1637767, AD-1637768, AD-1637769, AD-1637770, AD-1637771, AD-1637772, AD-1637773, AD-1637774, AD-1637775, AD-1637776, AD-1637777, AD-1637778, AD-1637779, AD-1637780, AD-1637781, AD-1637782, AD-1637783, AD-1637784, AD-1637785, AD-1637786, AD-1637787, AD-1637788, AD-1637789, AD-1637790, AD-1637791, AD-1637792, AD-1637793, AD-1637794, AD-1637795, AD-1637796, AD-1637797, AD-1637798, AD-1637799, AD-1637800, AD-1637801, AD-1637802, AD-1637803, AD-1637804, AD-1637805, AD-1637806, AD-1637807, AD-1637808, AD-1637809, AD-1637810, AD-1637811, AD-1637812, AD-1637813, AD-1637814, AD-1637815, AD-1637816, AD-1637817, AD-1637818, AD-1637819, AD-1637820, AD-1637821, AD-1637822, AD-1637823, AD-1637824, AD-1637825, AD-1637826, AD-1637827, AD-1637828, AD-1637829, AD-1637830, AD-1637831, AD-1637832, AD-1637833, AD-1637834, AD-1637835, AD-1637836, AD-1637837, AD-1637838, AD-1637839, AD-1637840, AD-1637841, AD-1637842, AD-1637843, AD-1637844, AD-1637845, AD-1637846, AD-1637847, AD-1637848, AD-1637849, AD-1637850, AD-1637851, AD-1637852, AD-1637853, AD-1637854, AD-1637855, AD-1637856, AD-1637857, AD-1637858, AD-1637859, AD-1637860, AD-1637861, AD-1637862, AD-1637863, AD-1637864, AD-1637865, AD-1637866, AD-1637867, AD-1637868, AD-1637869, AD-1637870, AD-1637871, AD-1637872, AD-1637873, AD-1637874, AD-1637875, AD-1637876, AD-1637877, AD-1637878, AD-1637879, AD-1637880, AD-1637881, AD-1637882, AD-1637883, AD-1637884, AD-1637885, AD-1637886, AD-1637887, AD-1637888, AD-1637889, AD-1637890, AD-1637891, AD-1637892, AD-1637893, AD-1637894, AD-1637895, AD-1637896, AD-1637897, AD-1637898, AD-1637899, AD-1637900, AD-1637901, AD-1637902, AD-1637903, AD-1637904, AD-1637905, AD-1637906, AD-1637907, AD-1637908, AD-1637909, AD-1637910, AD-1637911, AD-1637912, AD-1637913, AD-1637914, AD-1637915, AD-1637916, AD-1637917, AD-1637918, AD-1637919, AD-1637920, AD-1637921, AD-1637922, AD-1637923, AD-1637924, AD-1637925, AD-1637926, AD-1637927, AD-1637928, AD-1637929, AD-1637930, AD-1637931, AD-1637932, AD-1637933, AD-1637934, AD-1637935, AD-1637936, AD-1637937, AD-1637938, AD-1637939, AD-1637940, AD-1637941, AD-1637942, AD-1637943, AD-1637944, AD-1637945, AD-1637946, AD-1637947, AD-1637948, AD-1637949, AD-1637950, AD-1637951, AD-1637952, AD-1637953, AD-1637954, AD-1637955, AD-1637956, AD-1637957, AD-1637958, AD-1637959, AD-1637960, AD-397167, AD-523565, AD-1623140, AD-1637701, AD-1786708, and AD-1786708v2. In certain embodiments, the duplex is selected from the group consisting of AD-1637922, AD-1637806, AD-1637762, AD-1637777, AD-1637779, AD-1397081, AD-1637793, AD-1637798, AD-1637807, AD-1637829, AD-1637831, AD-1637840, AD-1637841, AD-1637855, AD-1637883, and AD-1637884. In certain embodiments, the duplex is selected from the group consisting of AD-1623140, AD-1786708, and AD-1637701. In certain embodiments, the duplex is AD-1786708.

In another aspect, the present invention provides a double stranded ribonucleic acid (dsRNA) agent for inhibiting expression of MAPT, wherein the dsRNA agent comprises a sense strand and an antisense strand forming a double stranded region, wherein the antisense strand comprises a region of complementarity to an mRNA encoding Tau, and wherein the region of complementarity comprises at least 17 contiguous nucleotides of the antisense sequence, UACCAUNCGAGCUUGGGUCACGU (SEQ ID NO. 1268), wherein only N is a nucleotide that is mismatched to the mRNA encoding Tau. In certain embodiments, N is I, A, C, T, or U. In certain embodiments, the antisense sequence is UACCAUHCGAGCUUGGGUCACGU (SEQ ID NO. 1269), wherein H is A, C, T, or U. In certain embodiments, the antisense sequence is UACCAUACGAGCUUGGGUCACGU (SEQ ID NO. 1003). In some embodiments, the region of complementarity comprises at least 18, 19, 20, or 21 contiguous nucleotides of the antisense sequence. In some embodiments, the region of complementarity consists of the antisense sequence. In some embodiments, the region of complementarity comprises at least nucleotides 1-17, 1-18, 1-19, 1-20, or 1-21 of the antisense sequence, counting from the 5'-end of the antisense sequence. In some embodiments, the region of complementarity comprises at least nucleotides 2-18, 2-19, 2-20, 2-21, or 2-22 of the antisense sequence, counting from the 5'-end of the antisense sequence.

In some embodiments, the nucleotide sequence of the sense and antisense strand comprises any one of the sense and antisense strand nucleotide sequences in any one of Tables 3-6.

In one embodiment, the nucleotide sequence of the sense strand comprises at least 15 contiguous nucleotides corresponding to the MAPT gene exon 10 sense strand sequence set forth in SEQ ID NO: 992 and an antisense strand comprising a sequence complementary thereto.

In one embodiment, the sense strand, the antisense strand, or both the sense strand and the antisense strand described herein, is/are conjugated to one or more lipophilic moieties.

In one embodiment, the lipophilic moiety is conjugated to one or more internal positions in the double stranded region of the dsRNA agent.

In one embodiment, the lipophilic moiety is conjugated via a linker or carrier.

In one embodiment, the lipophilicity of the lipophilic moiety, measured by log Kow, exceeds 0.

In one embodiment, the hydrophobicity of the double-stranded RNA agent, measured by the unbound fraction in a plasma protein binding assay of the double-stranded RNA agent, exceeds 0.2.

In one embodiment, the plasma protein binding assay is an electrophoretic mobility shift assay using human serum albumin protein.

In some embodiments, the dsRNA agent comprises at least one modified nucleotide.

In one embodiment, no more than five of the sense strand nucleotides and no more than five of the nucleotides of the antisense strand in a dsRNA agent of the present invention are unmodified nucleotides.

In one embodiment, all of the nucleotides of the sense strand and all of the nucleotides of the antisense strand in the dsRNA agent are modified nucleotides.

In some embodiments, at least one of the modified nucleotides of the dsRNA agent is selected from the group consisting of a deoxy-nucleotide, a 3'-terminal deoxythimidine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a 5'-phosphorothioate group, a nucleotide comprising a 5'-methylphosphonate group, a nucleotide comprising a 5' phosphate or 5' phosphate mimic, a nucleotide comprising vinyl phosphonate, a nucleotide comprising a glycol nucleic acid (GNA) (e.g., an adenosine-glycol nucleic acid (GNA)), a nucleotide comprising S-glycol nucleic acid (S-GNA) (e.g., a thymidine-glycol nucleic acid (GNA) S-Isomer), a 2'-5'-linked ribonucleotides ("3'-RNA"), a nucleotide comprising 2-hydroxymethyl-tetrahydrofuran-5-phosphate, a nucleotide comprising 2'-deoxythymidine-3'-phosphate, a nucleotide comprising 2'-deoxyguanosine-3'-phosphate, and a terminal nucleotide linked to a cholesteryl derivative and a dodecanoic acid bisdecylamide group; and combinations thereof.

In one embodiment, the modified nucleotide of the dsRNA agent is selected from the group consisting of a 2'-deoxy-2'-fluoro modified nucleotide, a 2'-deoxy-modified nucleotide, 3'-terminal deoxythimidine nucleotides (dT), a locked nucleotide, an abasic nucleotide, a 2'-amino-modified nucleotide, a 2'-alkyl-modified nucleotide, a morpholino nucleotide, a phosphoramidate, and a non-natural base comprising nucleotide.

In one embodiment, the modified nucleotide of the dsRNA comprises a short sequence of 3'-terminal deoxythimidine nucleotides (dT).

In one embodiment, the modifications on the nucleotides of the dsRNA agent are 2'-O-methyl, GNA and 2'-fluoro modifications.

In some embodiments, the dsRNA agent further comprises at least one phosphorothioate internucleotide linkage.

In one embodiment, the dsRNA agent comprises 6-8 phosphorothioate internucleotide linkages.

In one embodiment, each strand of the dsRNA is no more than 30 nucleotides in length.

In one embodiment, at least one strand of the dsRNA agent comprises a 3' overhang of at least 1 nucleotide. In another embodiment, at least one strand of the dsRNA agent comprises a 3' overhang of at least 2 nucleotides.

In some embodiments, the double stranded region of the dsRNA agent may be 15-30 nucleotide pairs in length; 17-23 nucleotide pairs in length; 17-25 nucleotide pairs in length; 23-27 nucleotide pairs in length; 19-21 nucleotide pairs in length; or 21-23 nucleotide pairs in length.

In some embodiments, each strand of the dsRNA may have 19-30 nucleotides; 19-23 nucleotides; or 21-23 nucleotides.

In one embodiment, one or more lipophilic moieties are conjugated to one or more internal positions on at least one strand, such as via a linker or carrier.

In one embodiment, the internal positions include all positions except the terminal two positions from each end of the at least one strand.

In another embodiment, the internal positions include all positions except the terminal three positions from each end of the at least one strand.

In one embodiment, the internal positions exclude a cleavage site region of the sense strand.

In one embodiment, the internal positions include all positions except positions 9-12, counting from the 5'-end of the sense strand.

In another embodiment, the internal positions include all positions except positions 11-13, counting from the 3'-end of the sense strand.

In one embodiment, the internal positions exclude a cleavage site region of the antisense strand.

In one embodiment, the internal positions include all positions except positions 12-14, counting from the 5'-end of the antisense strand.

In one embodiment, the internal positions include all positions except positions 11-13 on the sense strand, counting from the 3'-end, and positions 12-14 on the antisense strand, counting from the 5'-end.

In one embodiment, the one or more lipophilic moieties are conjugated to one or more of the internal positions selected from the group consisting of positions 4-8 and 13-18 on the sense strand, and positions 6-10 and 15-18 on the antisense strand, counting from the 5' end of each strand.

In another embodiment, the one or more lipophilic moieties are conjugated to one or more of the internal positions selected from the group consisting of positions 5, 6, 7, 15, and 17 on the sense strand, and positions 15 and 17 on the antisense strand, counting from the 5'-end of each strand.

In one embodiment, the internal positions in the double stranded region exclude a cleavage site region of the sense strand.

In one embodiment, the sense strand is 21 nucleotides in length, the antisense strand is 23 nucleotides in length, and the lipophilic moiety is conjugated to position 21, position 20, position 15, position 1, position 7, position 6, or position 2 of the sense strand or position 16 of the antisense strand.

In one embodiment, the lipophilic moiety is conjugated to position 21, position 20, position 15, position 1, or position 7 of the sense strand.

In another embodiment, the lipophilic moiety is conjugated to position 21, position 20, or position 15 of the sense strand.

In yet another embodiment, the lipophilic moiety is conjugated to position 20 or position 15 of the sense strand.

In one embodiment, the lipophilic moiety is conjugated to position 16 of the antisense strand.

In one embodiment, the lipophilic moiety is an aliphatic, alicyclic, or polyalicyclic compound.

In one embodiment, the lipophilic moiety is selected from the group consisting of lipid, cholesterol, retinoic acid, cholic acid, adamantane acetic acid, 1-pyrene butyric acid, dihydrotestosterone, 1,3-bis-O(hexadecyl)glycerol, geranyloxyhexyanol, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine.

In one embodiment, the lipophilic moiety contains a saturated or unsaturated C4-C30 hydrocarbon chain, and an optional functional group selected from the group consisting of hydroxyl, amine, carboxylic acid, sulfonate, phosphate, thiol, azide, and alkyne.

In one embodiment, the lipophilic moiety contains a saturated or unsaturated C6-C18 hydrocarbon chain.

In one embodiment, the lipophilic moiety contains a saturated or unsaturated C16 hydrocarbon chain.

In one embodiment, the saturated or unsaturated C16 hydrocarbon chain is conjugated to position 6, counting from the 5'-end of the strand.

In one embodiment, the lipophilic moiety is conjugated via a carrier that replaces one or more nucleotide(s) in the internal position(s) or the double stranded region.

In one embodiment, the carrier is a cyclic group selected from the group consisting of pyrrolidinyl, pyrazolinyl, pyrazolidinyl, imidazolinyl, imidazolidinyl, piperidinyl, piperazinyl, [1,3]dioxolanyl, oxazolidinyl, isoxazolidinyl, morpholinyl, thiazolidinyl, isothiazolidinyl, quinoxalinyl, pyridazinonyl, tetrahydrofuranyl, and decalinyl; or is an acyclic moiety based on a serinol backbone or a diethanolamine backbone.

In one embodiment, the lipophilic moiety is conjugated to the double-stranded iRNA agent via a linker containing an ether, thioether, urea, carbonate, amine, amide, maleimide-thioether, disulfide, phosphodiester, sulfonamide linkage, a product of a click reaction, or carbamate.

In one embodiment, the lipophilic moiety is conjugated to a nucleobase, sugar moiety, or internucleosidic linkage.

In one embodiment, the lipophilic moiety or targeting ligand is conjugated via a bio-linker selected from the group consisting of DNA, RNA, disulfide, amide, functionalized monosaccharides or oligosaccharides of galactosamine, glucosamine, glucose, galactose, mannose, and combinations thereof.

In one embodiment, the 3' end of the sense strand is protected via an end cap which is a cyclic group having an amine, said cyclic group being selected from the group consisting of pyrrolidinyl, pyrazolinyl, pyrazolidinyl, imidazolinyl, imidazolidinyl, piperidinyl, piperazinyl, [1,3] dioxolanyl, oxazolidinyl, isoxazolidinyl, morpholinyl, thiazolidinyl, isothiazolidinyl, quinoxalinyl, pyridazinonyl, tetrahydrofuranyl, and decalinyl.

In one embodiment, the dsRNA agent further comprises a targeting ligand that targets a neuronal cell.

In one embodiment, the dsRNA agent further comprises a targeting ligand that targets a liver cell.

In one embodiment, the targeting ligand is a GalNAc conjugate.

In one embodiment, the dsRNA agent further comprises a terminal, chiral modification occurring at the first internucleotide linkage at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp configuration or Sp configuration.

In another embodiment, the dsRNA agent further comprises a terminal, chiral modification occurring at the first and second internucleotide linkages at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In yet another embodiment, the dsRNA agent further comprises a terminal, chiral modification occurring at the first, second and third internucleotide linkages at the 3' end of the antisense strand, having the linkage phosphorus atom in Sp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In another embodiment, the dsRNA agent further comprises a terminal, chiral modification occurring at the first, and second internucleotide linkages at the 3' end of the antisense strand, having the linkage phosphorus atom in Sp configuration, a terminal, chiral modification occurring at the third internucleotide linkages at the 3' end of the antisense strand, having the linkage phosphorus atom in Rp configuration, a terminal, chiral modification occurring at the first internucleotide linkage at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In another embodiment, the dsRNA agent further comprises a terminal, chiral modification occurring at the first, and second internucleotide linkages at the 3' end of the antisense strand, having the linkage phosphorus atom in Sp configuration, a terminal, chiral modification occurring at the first, and second internucleotide linkages at the 5' end of the antisense strand, having the linkage phosphorus atom in Rp configuration, and a terminal, chiral modification occurring at the first internucleotide linkage at the 5' end of the sense strand, having the linkage phosphorus atom in either Rp or Sp configuration.

In one embodiment, the dsRNA agent further comprises a phosphate or phosphate mimic at the 5'-end of the antisense strand.

In one embodiment, the phosphate mimic is a 5'-vinyl phosphonate (VP).

In one embodiment, the phosphate mimic is a 5'-cyclopropyl phosphonate.

In one embodiment, the base pair at the 1 position of the 5'-end of the antisense strand of the duplex is an AU base pair.

In one embodiment, the sense strand has a total of 21 nucleotides and the antisense strand has a total of 23 nucleotides.

In another embodiment, the dsRNA agent is a pharmaceutically acceptable salt thereof. “Pharmaceutically acceptable salts” of each of dsRNA agents herein include, but are not limited to, a sodium salt, a calcium salt, a lithium salt, a potassium salt, an ammonium salt, a magnesium salt, an mixtures thereof. One skilled in the art will appreciate that the dsRNA agent, when provided as a polycationic salt having one cation per free acid group of the optionally modified phosophodiester backbone and/or any other acidic modifications (e.g., 5'-terminal phosphonate groups). For example, an oligonucleotide of “n” nucleotides in length contains n−1 optionally modified phosophodiesters, so that an oligonucleotide of 21 nt in length may be provided as a salt having up to 20 cations (e.g, 20 sodium cations). Similarly, a dsRNA agents having a sense strand of 21 nt in length and an antisense strand of 23 nt in length may be provided as a salt having up to 42 cations (e.g, 42 sodium cations). In the preceding example, where the dsRNA agent also includes a 5'-terminal phosphate or a 5'-terminal vinylphosphonate group, the dsRNA agent may be provided as a salt having up to 44 cations (e.g, 44 sodium cations).

The present invention also provides cells and pharmaceutical compositions comprising a dsRNA agent of the invention and a lipid formulation.

The present invention also provides pharmaceutical compositions for inhibiting expression of a gene encoding MAPT comprising a dsRNA agent of the invention.

The present invention also provides pharmaceutical compositions for selective inhibition of exon 10-containing MAPT transcripts comprising a dsRNA agent of the invention.

In one embodiment, the dsRNA agent is in an unbuffered solution, such as saline or water.

In another embodiment, the dsRNA agent is in a buffer solution, such as a buffer solution comprising acetate, citrate, prolamine, carbonate, or phosphate or any combination thereof; or phosphate buffered saline (PBS).

In one aspect, the present invention provides a method of inhibiting expression of a MAPT gene in a cell, the method comprising contacting the cell with a dsRNA agent of the invention, or a pharmaceutical composition of the invention, thereby inhibiting expression of the MAPT gene in the cell.

In another aspect, the present invention provides a method comprises selective inhibition of exon 10-containing MAPT transcripts in a cell, the method comprising contacting the cell with a dsRNA agent of the invention, or a pharmaceutical composition of the invention, thereby selectively degrading exon 10-containing MAPT transcripts in the cell.

In one embodiment, the cell is within a subject.

In one embodiment, the subject is a human.

In one embodiment, the subject has a MAPT-associated disorder.

In one embodiment, the subject has a MAPT-associated disorder that is a neurodegenerative disorder.

In one embodiment, the neurodegenerative disorder of the subject is associated with an abnormality of MAPT gene encoded protein Tau.

In one embodiment, the abnormality of MAPT gene encoded protein Tau results in aggregation of Tau in subject’s brain.

In one embodiment, the neurodegenerative disorder is a familial disorder.

In one embodiment, the neurodegenerative disorder is a sporadic disorder.

In one embodiment, the MAPT-associated disorder is selected from the group consisting of tauopathy, Alzheimer disease, frontotemporal dementia (FTD), behavioral variant frontotemporal dementia (bvFTD), nonfluent variant primary progressive aphasia (nfvPPA), primary progressive aphasia-semantic (PPA-S), primary progressive aphasia-logopenic (PPA-L), frontotemporal dementia with parkinsonism linked to chromosome 17 (FTDP-17), Pick’s disease (PiD), argyrophilic grain disease (AGD), multiple system tauopathy with presenile dementia (MSTD), white matter tauopathy with globular glial inclusions (FTLD with GGIs), FTLD with MAPT mutations, neurofibrillary tangle (NFT) dementia, FTD with motor neuron disease, amyotrophic lateral sclerosis (ALS), corticobasal syndrome (CBS), corticobasal degeneration (CBD), progressive supranuclear palsy (PSP), Parkinson’s disease, postencephalitic Parkinsonism, Niemann-Pick disease, Huntington disease, type 1 myotonic dystrophy, and Down syndrome (DS).

In some embodiments, contacting the cell with the dsRNA agent inhibits the expression of MAPT by at least about 25%, at least about 30%, at least about 40%, at least about 50%, at least about 60%, at least about 70%, at least about 80%, at least about 90%, or at least about 95%, relative to control levels. In one embodiment, the dsRNA agent inhibits the expression of MAPT by at least about 25%.

In some embodiments, inhibiting expression of MAPT decreases Tau protein level in serum of the subject by at least about 25%, at least about 30%, at least about 40%, at least about 50%, at least about 60%, at least about 70%, at least about 80%, at least about 90%, or at least about 95%, relative to control levels. In one embodiment, the dsRNA agent decreases Tau protein level in serum of the subject by at least about 25%.

In one aspect, the present invention provides a method of treating a subject having a disorder that would benefit from reduction in MAPT expression, comprising administering to the subject a therapeutically effective amount of a dsRNA agent of the invention, or a pharmaceutical composition of the invention, thereby treating the subject having the disorder that would benefit from reduction in MAPT expression.

In another aspect, the present invention provides a method of preventing at least one symptom in a subject having a disorder that would benefit from reduction in MAPT expression, comprising administering to the subject a prophylactically effective amount of a dsRNA agent of the invention, or a pharmaceutical composition of the invention, thereby preventing at least one symptom in the subject having the disorder that would benefit from reduction in MAPT expression.

In one embodiment, the disorder is a MAPT-associated disorder.

In one embodiment, the disorder is associated with an abnormality of MAPT gene encoded protein Tau.

In one embodiment, the abnormality of MAPT gene encoded protein Tau results in aggregation of Tau in subject's brain.

In one embodiment, the MAPT-associated disorder is selected from the group consisting of tauopathy, Alzheimer disease, frontotemporal dementia (FTD), behavioral variant frontotemporal dementia (bvFTD), nonfluent variant primary progressive aphasia (nfvPPA), primary progressive aphasia-semantic (PPA-S), primary progressive aphasia-logopenic (PPA-L), frontotemporal dementia with parkinsonism linked to chromosome 17 (FTDP-17), Pick's disease (PiD), argyrophilic grain disease (AGD), multiple system tauopathy with presenile dementia (MSTD), white matter tauopathy with globular glial inclusions (FTLD with GGIs), FTLD with MAPT mutations, neurofibrillary tangle (NFT) dementia, FTD with motor neuron disease, amyotrophic lateral sclerosis (ALS), corticobasal syndrome (CBS), corticobasal degeneration (CBD), progressive supranuclear palsy (PSP), Parkinson's disease, postencephalitic Parkinsonism, Niemann-Pick disease, Huntington disease, type 1 myotonic dystrophy, and Down syndrome (DS).

In one embodiment, the subject is human.

In one embodiment, the administration of the dsRNA agent of the invention, or the pharmaceutical composition of the invention, causes a decrease in Tau aggregation in the subject's brain.

In one embodiment, the administration of the agent to the subject causes a decrease in Tau accumulation.

In one embodiment, the dsRNA agent is administered to the subject at a dose of about 0.01 mg/kg to about 50 mg/kg.

In another embodiment, the dsRNA agent is administered to the subject intrathecally.

In yet another embodiment, the dsRNA agent is administered to the subject intracisternally. A non-limiting exemplary intracisternal administration comprises an injection into the cisterna *magna* (cerebellomedullary cistern) by suboccipital puncture.

In one embodiment, the methods of the invention further comprise determining the level of MAPT in a sample(s) from the subject.

In one embodiment, the level of MAPT in the subject sample(s) is a Tau protein level in a blood, serum, or cerebrospinal fluid sample(s).

In one embodiment, the methods of the invention further comprise administering to the subject an additional therapeutic agent.

In one aspect, the present invention provides a kit comprising a dsRNA agent of the invention, or a pharmaceutical composition of the invention.

In another aspect, the present invention provides a vial comprising a dsRNA agent of the invention, or a pharmaceutical composition of the invention.

In yet another aspect, the present invention provides a syringe comprising a dsRNA agent of the invention, or a pharmaceutical composition of the invention.

In another aspect, the present invention provides an intrathecal pump comprising a dsRNA agent of the invention, or a pharmaceutical composition of the invention.

In another aspect, the present invention provides a double stranded ribonucleic acid (dsRNA) agent, or a pharmaceutically acceptable salt thereof, comprising a sense strand and an antisense strand forming a double stranded region, wherein the nucleotide sequence of the antisense strand differs by no more than three bases from the nucleotide sequence, 5'-VPusAfsccdAudAcgagcuUfgGfgucacsgsu-3' (SEQ ID. NO: 1011), wherein VP is a 5'-vinyl phosphonate; s is a phosphorothioate linkage; a, c, g, and u are 2'-O-methyl (2'-OMe) A, C, G, and U, respectively; dA is 2'-deoxy A; and Af, Gf, Uf are 2'-deoxy-2'-fluoro (2'-F) A, G, and U, respectively. In certain embodiments, the nucleotide sequence of the antisense strand differs by no more than two bases from the nucleotide sequence of SEQ ID. NO: 1011). In certain embodiments, the nucleotide sequence of the antisense strand differs by no more than one base from the nucleotide sequence of SEQ ID. NO: 1011. In certain embodiments, the sense strand comprises the nucleotide sequence, 5'-gsusgac(Chd)caAfGfCfucguauggsusa-3' (SEQ ID. NO: 1007), wherein (Chd) is 2'-O-hexadecyl-cytidine-3'-phosphate; s is a phosphorothioate linkage; a, c, g, and u are 2'-O-methyl (2'-OMe) A, C, G, and U, respectively; and Af, Cf, and Gf are 2'-deoxy-2'-fluoro (2'-F) A, C, and G, respectively. In certain embodiments, the dsRNA agent is a sodium salt.

In another aspect, the present invention provides a double stranded ribonucleic acid (dsRNA) agent, or a pharmaceutically acceptable salt thereof, comprising a sense strand and an antisense strand forming a double stranded region, wherein the antisense strand comprises the nucleotide sequence, 5'-VPusAfsccdAudAcgagcuUfgGfgucacsgsu-3' (SEQ ID. NO: 1011). In certain embodiments, the sense strand comprises the nucleotide sequence, 5'-gsusgac(Chd)caAfGfCfucguauggsusa-3' (SEQ ID. NO: 1007). In certain embodiments, the dsRNA agent is a sodium salt.

In another aspect, the present invention provides a double stranded ribonucleic acid (dsRNA) agent, or a pharmaceutically acceptable salt thereof, comprising a sense strand and an antisense strand forming a double stranded region, wherein the sense strand consists of the nucleotide sequence, 5'-gsusgac(Chd)caAfGfCfucguauggsusa-3' (SEQ ID. NO: 1007), and the antisense strand consists of the nucleotide sequence, 5'-VPusAfsccdAudAcgagcuUfgGfgucacsgsu-3' (SEQ ID. NO: 1011). In certain embodiments, the dsRNA agent is a sodium salt.

In another aspect, the present invention provides a double stranded ribonucleic acid (dsRNA) agent, or a pharmaceutically acceptable salt thereof, comprising a sense strand and an antisense strand forming a double stranded region, wherein the nucleotide sequence of the antisense strand differs by no more than three bases from the nucleotide sequence, 5'-VPusUfsggdTu(Tgn)guagacUfaUfuugcascsa-3' (SEQ ID. NO: 1010), wherein VP is a 5'-vinyl phosphonate; s is a phosphorothioate linkage; a, c, g, and u are 2'-O-methyl (2'-OMe) A, C, G, and U, respectively; dT is 2'-deoxy T; Af, Gf, Uf are 2'-deoxy-2'-fluoro (2'-F) A, G, and U, respectively; and (Tgn) is thymidine-glycol nucleic acid (GNA) S-isomer. In certain embodiments, the nucleotide sequence of the antisense strand differs by no more than two bases from the nucleotide sequence of SEQ ID. NO: 1010). In certain embodiments, the nucleotide sequence of the antisense strand differs by no more than one base from the nucleotide sequence of SEQ ID. NO: 1010. In certain embodiments, the sense strand comprises the nucleotide sequence, 5'-usgscaa(Ahd)UfaGfUfCfuacaaaccsasa-3' (SEQ ID. NO: 1006), wherein (Ahd) is 2'-O-hexadecyl-adenosine-3'-phosphate; s is a phosphorothioate linkage; a, c, g, and u are 2'-O-methyl (2'-OMe) A, C, G, and U, respectively; and Af, Cf, and Gf are 2'-deoxy-2'-fluoro (2'-F) A, C, and G, respectively. In certain embodiments, the dsRNA agent is a sodium salt.

In another aspect, the present invention provides a double stranded ribonucleic acid (dsRNA) agent, or a pharmaceutically acceptable salt thereof, comprising a sense strand and an antisense strand forming a double stranded region, wherein the antisense strand comprises the nucleotide sequence, 5'-VPusUfsggdTu(Tgn)guagacUfaUfuugcascsa-3' (SEQ ID. NO: 1010). In certain embodiments, the sense strand comprises the nucleotide sequence, 5'-usgscaa(Ahd)UfaGfUfCfuacaaaccsasa-3' (SEQ ID. NO: 1006). In certain embodiments, the dsRNA agent is a sodium salt.

In another aspect, the present invention provides a double stranded ribonucleic acid (dsRNA) agent, or a pharmaceutically acceptable salt thereof, comprising a sense strand and an antisense strand forming a double stranded region, wherein the sense strand consists of the nucleotide sequence, 5'-usgscaa(Ahd)UfaGfUfCfuacaaaccsasa-3' (SEQ ID. NO: 1006), and the antisense strand consists of the nucleotide sequence, 5'-VPusUfsggdTu(Tgn)guagacUfaUfuugcascsa-3' (SEQ ID. NO: 1010). In certain embodiments, the dsRNA agent is a sodium salt.

In another aspect, the present invention provides a double stranded ribonucleic acid (dsRNA) agent, or a pharmaceutically acceptable salt thereof, comprising a sense strand and an antisense strand forming a double stranded region, wherein the nucleotide sequence of the antisense strand differs by no more than three bases from the nucleotide sequence, 5'-VPusUfscadAc(Tgn)gguuugUfaGfacuaususu-3' (SEQ ID. NO: 1009), wherein VP is a 5'-vinyl phosphonate; s is a phosphorothioate linkage; a, c, g, and u are 2'-O-methyl (2'-OMe) A, C, G, and U, respectively; dA is 2'-deoxy A; Af, Gf, Uf are 2'-deoxy-2'-fluoro (2'-F) A, G, and U, respectively; and (Tgn) is thymidine-glycol nucleic acid (GNA) S-isomer. In certain embodiments, the nucleotide sequence of the antisense strand differs by no more than two bases from the nucleotide sequence of SEQ ID. NO: 1009). In certain embodiments, the nucleotide sequence of the antisense strand differs by no more than one base from the nucleotide sequence of SEQ ID. NO: 1009. In certain embodiments, the sense strand comprises the nucleotide sequence, 5'-asusagu(Chd)uaCfAfAfaccaguugsasa-3' (SEQ ID. NO: 1005), wherein (Chd) is 2'-O-hexadecyl-cytidine-3'-phosphate; s is a phosphorothioate linkage; a, c, g, and u are 2'-O-methyl (2'-OMe) A, C, G, and U, respectively; and Af, Cf, and Gf are 2'-deoxy-2'-fluoro (2'-F) A, C, and G, respectively. In certain embodiments, the dsRNA agent is a sodium salt.

In another aspect, the present invention provides a double stranded ribonucleic acid (dsRNA) agent, or a pharmaceutically acceptable salt thereof, comprising a sense strand and an antisense strand forming a double stranded region, wherein the antisense strand comprises the nucleotide sequence, 5'-VPusUfscadAc(Tgn)gguuugUfaGfacuaususu-3' (SEQ ID. NO: 1009). In certain embodiments, the sense strand comprises the nucleotide sequence, 5'-asusagu(Chd) uaCfAfAfaccaguugsasa-3' (SEQ ID. NO: 1005). In certain embodiments, the dsRNA agent is a sodium salt.

In another aspect, the present invention provides a double stranded ribonucleic acid (dsRNA) agent, or a pharmaceutically acceptable salt thereof, comprising a sense strand and an antisense strand forming a double stranded region, wherein the sense strand consists of the nucleotide sequence, 5'-asusagu(Chd)uaCfAfAfaccaguugsasa-3' (SEQ ID. NO: 1005), and the antisense strand consists of the nucleotide sequence, 5'-VPusUfscadAc(Tgn)gguuugUfaGfacuaususu-3' (SEQ ID. NO: 1009). In certain embodiments, the dsRNA agent is a sodium salt.

The present invention also pharmaceutical compositions comprising one of the aforementioned dsRNA agents of the invention and a pharmaceutically acceptable diluent. In certain embodiments, the pharmaceutical composition may be a sterile aqueous solution. In certain embodiments, the sterile aqueous solution may comprise a buffer. In certain embodiments, the diluent of the sterile aqueous solution may be saline or water.

In one aspect, the present invention provides a method of inhibiting expression of a MAPT gene in a cell, the method comprising contacting the cell with any one of the aforementioned dsRNA agents and maintaining the cell produced for a time sufficient to obtain degradation of the mRNA transcript of the MAPT gene, thereby inhibiting expression of the MAPT gene in the cell.

In another aspect, the present invention provides a method for treating a MAPT-associated neurodegenerative disease, comprising administering to a patient in need thereof, a pharmaceutically effective amount of any one of the aforementioned dsRNA agents. In certain embodiments, the MAPT-associated neurodegenerative disease is selected from the group consisting of tauopathy, Alzheimer's disease, frontotemporal dementia (FTD), behavioral variant frontotemporal dementia (bvFTD), nonfluent variant primary progressive aphasia (nfvPPA), primary progressive aphasia-semantic (PPA-S), primary progressive aphasia-logopenic (PPA-L), frontotemporal dementia with parkinsonism linked to chromosome 17 (FTDP-17), Pick's disease (PiD), argyrophilic grain disease (AGD), multiple system tauopathy with presenile dementia (MSTD), white matter tauopathy with globular glial inclusions (FTLD with GGIs), FTLD with MAPT mutations, neurofibrillary tangle (NFT) dementia, FTD with motor neuron disease, amyotrophic lateral sclerosis (ALS), corticobasal syndrome (CBS), corticobasal degeneration (CBD), progressive supranuclear palsy (PSP), Parkinson's disease, postencephalitic Parkinsonism, Niemann-Pick disease, Huntington disease, type 1 myotonic dystrophy, and Down syndrome (DS). In a specific embodiment, the MAPT-associated neurodegenerative disease is Alzheimer's disease. In another specific embodiment, the MAPT-associated neurodegenerative disease is progressive supranuclear palsy (PSP). In yet another specific embodiment, the MAPT-associated neurodegenerative disease is tauopathy.

BRIEF SUMMARY OF THE FIGURES

FIGS. 2A1-2A6 and 2B1-2B6 show off-target effects of select duplexes. The top panels (FIGS. 2A1, 2A3, 2A5, 2B1, 2B3, 2B5) show MA plots of $Log_2$ fold change in gene expression versus the average normalized gene expression for genes in control (mock treated) cells and duplex-treated cells. Each data point represents a single gene. Open squares and open triangles represent a significant change in gene expression ($p<0.05$) whereas grey dots do not. Open squares and dark grey dots represent genes having a canonical seed match (8mer or 7mer) in their 3' UTRs. The bottom panels (FIGS. 2A2, 2A4, 2A6, 2B2, 2B4, 2B6) show cumulative distribution function plots having genes with canonical seed matches to the "true" seed from the antisense strand of the duplex split out. The lines represent "background" genes having no canonical seed matches to the antisense strand, genes having mer8 canonical seed matches to the antisense strand, genes having mer7 (m8) canonical seed matches, and genes having mer7 (A1) canonical seed matches to the antisense strand, as indicated in the figure legend. FIGS. 2A1-2A6 show the off-target effects of AD-1637760, AD-1637761, and AD-1637762. FIGS. 2B1-2B6 show the off-target effects of AD-1637763, AD-1637764, and AD-1637765.

FIG. 3A is a dot plot of and FIG. 3B is a bar graph.

FIG. 4A is a dot plot of and FIG. 4B is a bar graph.

FIG. 6 shows the NHP screen in various tissues at day 113 post treatment with respect to effect on tau protein expression, relative to treatment with aCSF.

FIG. 7A shows the correlation for the percent remaining MAPT mRNA at day 29 post treatment, including the $IC_{50}$ determined for each duplex. FIG. 7B shows the correlation for the percent remaining MAPT mRNA at day 113 post treatment. FIG. 7C shows the correlation for the percent remaining tau protein at day 113 post treatment.

DETAILED DESCRIPTION OF THE INVENTION

Figure 1:
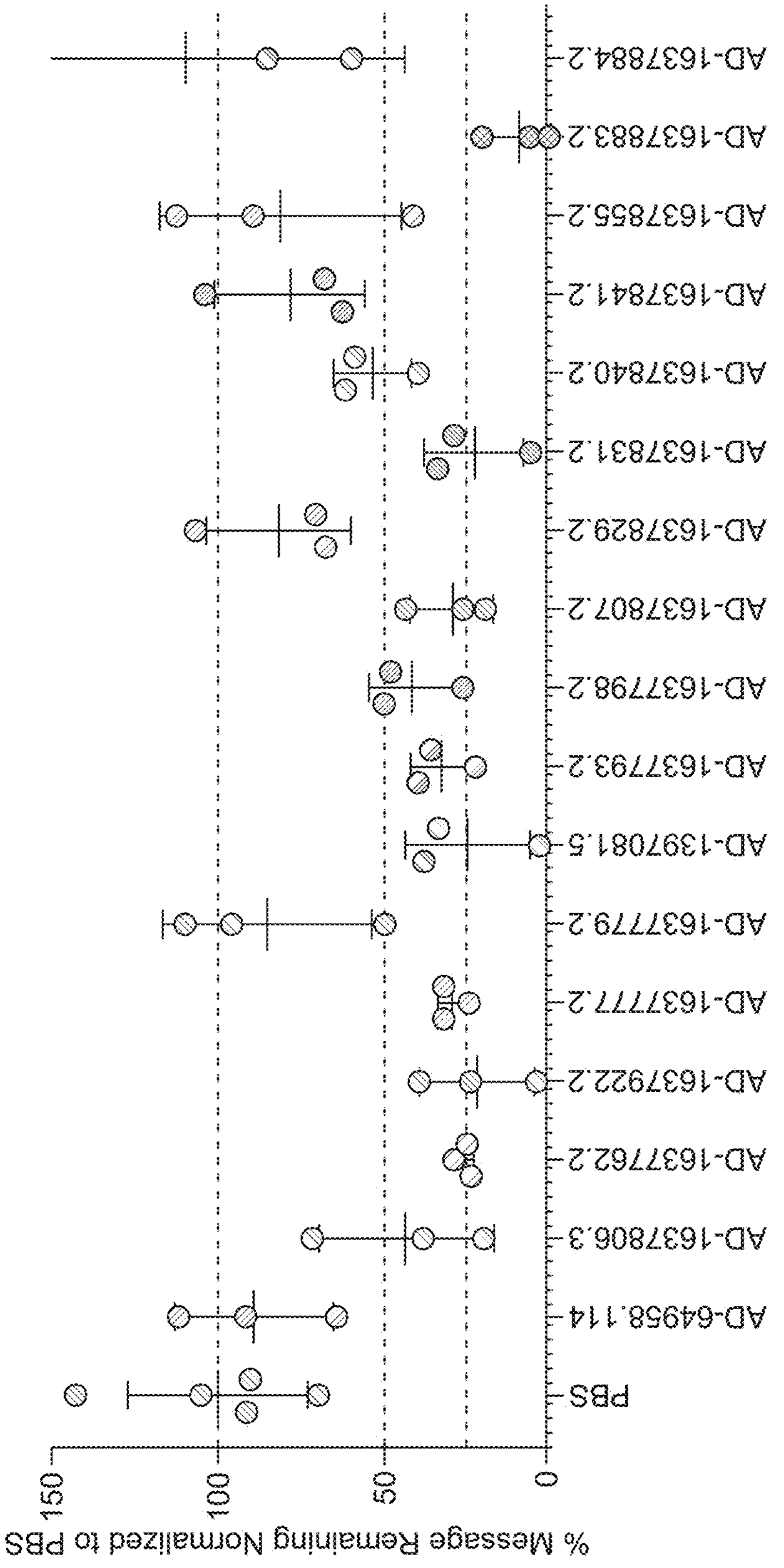
FIG. 1 shows the AAV screen in liver to determine the effect of RNAi compositions on MAPT expression. Vertical axis indicates human MAPT expression in mice dosed with RNAi compositions relative to the MAPT expression levels in PBS dosed mice.

The present disclosure provides RNAi compositions, which effect the RNA-induced silencing complex (RISC)-mediated cleavage of RNA transcripts of a MAPT gene. The MAPT gene may be within a cell, e.g., a cell within a subject, such as a human. The use of these iRNAs enables the targeted degradation of mRNAs of the corresponding gene (MAPT gene) in mammals.

The iRNAs of the invention have been designed to target a MAPT gene, e.g., a MAPT gene either with or without nucleotide modifications. The iRNAs of the invention inhibit the expression of the MAPT gene by at least about 25%, and reduce the level of sense- and antisense-containing foci. Without intending to be limited by theory, it is believed that a combination or sub-combination of the foregoing properties and the specific target sites, or the specific modifications in these iRNAs confer to the iRNAs of the invention improved efficacy, stability, potency, durability, and safety.

Accordingly, the present disclosure also provides methods of using the RNAi compositions of the disclosure for inhibiting the expression of a MAPT gene or for treating a subject having a disorder that would benefit from inhibiting or reducing the expression of a MAPT gene, e.g., a MAPT-associated disease, for example, Alzheimer's disease, FTD, PSP, or another tauopathy.

The RNAi agents of the disclosure include an RNA strand (the antisense strand) having a region which is about 30 nucleotides or less in length, e.g., 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of a MAPT gene, e.g., an MAPT exon. In certain embodiments, the RNAi agents of the disclosure include an RNA strand (the antisense strand) having a region which is about 21-23 nucleotides in length, which region is substantially complementary to at least part of an mRNA transcript of a MAPT gene.

In certain embodiments, the RNAi agents of the disclosure include an RNA strand (the antisense strand) which includes longer lengths, for example up to 66 nucleotides, e.g., 36-66, 26-36, 25-36, 31-60, 22-43, 27-53 nucleotides in length with a region of at least 19 contiguous nucleotides that is substantially complementary to at least a part of an mRNA transcript of a MAPT gene. These RNAi agents with the longer length antisense strands preferably include a second RNA strand (the sense strand) of 20-60 nucleotides in length wherein the sense and antisense strands form a duplex of 18-30 contiguous nucleotides.

The use of these RNAi agents enables the targeted degradation and/or inhibition of mRNAs of a MAPT gene in mammals. Thus, methods and compositions including these RNAi agents are useful for treating a subject who would benefit by a reduction in the levels or activity of a Tau, such as a subject having a MAPT-associated disease, such as Alzheimer's disease, FTD, PSP, or another tauopathy.

The following detailed description discloses how to make and use compositions containing RNAi agents to inhibit the expression of a MAPT gene, as well as compositions and methods for treating subjects having diseases and disorders that would benefit from inhibition or reduction of the expression of the genes.

I. Definitions

In order that the present disclosure may be more readily understood, certain terms are first defined. In addition, it should be noted that whenever a value or range of values of a parameter are recited, it is intended that values and ranges intermediate to the recited values are also intended to be part of this disclosure.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to." The term "or" is used herein to mean, and is used interchangeably with, the term "and/or," unless context clearly indicates otherwise.

The term "about" is used herein to mean within the typical ranges of tolerances in the art. For example, "about" is to be understood as about 2 standard deviations from the mean. In certain embodiments, about means ±10%. In certain embodiments, about means ±5%. When about is present before a series of numbers or a range, it is understood that "about" modifies each of the numbers in the series or range.

The term "at least" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 18 nucleotides of a 21 nucleotide nucleic acid molecule" means that 18, 19, 20, or 21 nucleotides have the indicated property. When "at least" is present before a series of numbers or a range, it is understood that "at least" modifies each of the numbers in the series or range. As used herein, "no more than" or "less than" is understood as the value adjacent to the phrase and logical lower values or integers, as logical from context, to zero. For example, a duplex with an overhang of "no more than 2 nucleotides" has a 2, 1, or 0 nucleotide overhang. When "no more than" is present before a series of numbers or a range, it is understood that "no more than" modifies each of the numbers in the series or range.

As used herein, the term "at least about", when referring to a measurable value such as a parameter, an amount, and the like, is meant to encompass variations of +/−20%, preferably +/−10%, more preferably +/−5%, and still more preferably +/−1% from the specified value, insofar such variations are appropriate to perform in the disclosed invention. For example, the inhibition of expression of the MAPT gene by "at least about 25%" means that the inhibition of expression of the MAPT gene is be measured to be any value +/−20% of the specified 25%, i.e., 20%, 30% or any intermediary value between 20-30%.

As used herein, "control level" refers to the levels of expression of a gene, or expression level of an RNA molecule or expression level of one or more proteins or protein subunits, in a non-modulated cell, tissue or a system identical to the cell, tissue or a system where the RNAi agents, described herein, are expressed. The cell, tissue or a system where the RNAi agents are expressed, have at least 5%, 10%, 20%, 30%, 40%, 50%, 60%, 70%, 80%, 90%, 100%, 2-fold, 3-fold, 4-fold, 5-fold or more expression of the gene, RNA and/or protein described above from that observed in the absence of the RNAi agent. The % and/or fold difference is to be calculated relative to the control levels, for example, $$\% \text{ difference} = \frac{[\text{expression with } RNAi \text{ agent} - \text{expression without } RNAi \text{ agent}]}{\text{expression without } RNAi \text{ agent}} \times 100$$

As used herein, methods of detection include determination that the amount of analyte present is below the level of detection of the method.

In the event of a conflict between an indicated target site and the nucleotide sequence for a sense or antisense strand, the indicated sequence takes precedence.

In the event of a conflict between a chemical structure and a chemical name, the chemical structure takes precedence.

The term "MAPT" gene, also known as "DDPAC," "FTDP-17," "MAPTL," "MSTD," "MTBT1," "MTBT2," "PPND," "PPP1R103," "TAU," and "microtubule-associated protein tau," refers to the gene encoding for a protein called microtubule-associated protein tau (MAPT).

The MAPT mRNA is expressed throughout the body, predominantly in the central nervous system (i.e., the brain and the spinal cord) and the peripheral nervous system. Wild type Tau is involved in stabilizing microtubules in neuronal axons, regulating axonal transport and microtubule dynamics, maintaining dendric spines, and contributing to genomic DNA integrity.

Tauopathies are a heterogeneous class of progressive neurodegenerative disorders pathologically characterized by the presence of Tau aggregates in the brain. Intra- and extra-cellular neuronal Tau aggregates cause microtubule disassembly and axonal degeneration, impaired synaptic vesicle release, and prion-like inter-neuronal spread of tau aggregates called "seeding."

Phenotypically, tauopathies show variable progression of motor, cognitive, and behavioral impairment. Tauopathies include, but are not limited to, Alzheimer's disease, the most common form of presenile dementia that primarily starts with selective memory impairment, and is associated with degeneration of the frontal lobe, temporal lobe (including hippocampus), and parietal lobe of the brain; frontotemporal dementia (FTD), the second most common form of presenile dementia associated with neuronal atrophy of the frontal and temporal lobes, exhibiting a spectrum of behavioral, language, and movement disorders; and progressive supranuclear palsy (PSP), degeneration of brainstem and basal ganglia, exhibiting gaze dysfunction, extrapyramidal symptoms (Parkinsonism symptoms including limb apraxia, akinesia/bradykinesia, rigidity, and dystonia), and cognitive dysfunction, affecting approximately 20,000 people in the United States.

FTD further includes, but are not limited to, behavioral variant frontotemporal dementia (bvFTD), associated pathologically with progressive atrophy in the prefrontal and anterior temporal lobes, and clinically with alterations in complex thinking, personality, and behavior, affecting approximately 30,000 people in the United states; primary progressive aphasia-semantic (PPA-S), degeneration of frontal and temporal lobes associated with difficulty comprehending words and struggle with naming; nonfluent variant primary progressive aphasia (nfvPPA), involving degeneration of left post frontal lobe and insula, and exhibiting poor grammar and inability to understand complex sentences, affecting approximately 1,000 people in the United States; primary progressive aphasia-logopenic (PPA-L), degeneration of the left post/spur temporal lobe and the medial parietal lobe, associated with difficulty retrieving words and frequent pauses; frontotemporal dementia with parkinsonism linked to chromosome 17 (FTDP-17), associated pathologically with degeneration of the frontal and temporal lobes, and clinically with speech and movement impairment; Pick's disease (PiD), degeneration of the frontal and temporal lobes, associated with difficulty in language and thinking and behavioral changes; FTD with motor neuron disease, involving degeneration of the cortex and motor neurons; and corticobasal syndrome (CBS), degeneration of posterior frontal and temporal lobes and basal ganglia [i.e., corticobasal degeneration (CBD)], exhibiting extrapyramidal symptoms (similar to those in Parkinson's disease and PSP) and cognitive dysfunction, affecting approximately 2,000 people in the United States. Mutations of MAPT are reported in approximately 10% of patients with bvFTD, nfvPPA, CBS, and PSP, respectively. MAPT is a major component of neurofibrillary tangles in the neuronal cytoplasm, a hallmark in Alzheimer's disease. The aggregation and deposition of MAPT were also observed in approximately 50% of the brains of patients with Parkinson's disease. Involvement of Tau is indicated in the pathogenesis of other diseases including, but not limited to, argyrophilic grain disease (AGD), multiple system tauopathy with presenile dementia (MSTD), white matter tauopathy with globular glial inclusions (FTLD with GGIs), FTLD with MAPT mutations, neurofibrillary tangle (NFT) dementia, FTD with motor neuron disease, amyotrophic lateral sclerosis (ALS), postencephalitic Parkinsonism, Niemann- Pick disease, Huntington disease, type 1 myotonic dystrophy, and Down syndrome (DS).

The MAPT gene consists of 16 exons (E1-E16). Alternative mRNA splicing of E2, E3, and E10 gives rise to six tau isoforms (352-441 amino acids). E1, E4, E5, E7, E9, E11, E12, E13 are the constitutively spliced exons. E6 and E8 are not transcribed in human brain. E4a is only expressed in the peripheral nervous system. E0 (part of the promotor) and E14 are noncoding exons.

Pathogenic variants in MAPT are found in approximately 10% of patients with primary tauopathy. Variants are primarily missense and localized in exons 9-13 (microtubule binding domains), with many affecting the alternative splicing of exon 10. Examples of coding region mutations include R5H and R5L in E1; K257T, I260V, L266V, G272V, and G273R in E9; N279K, L284L, ΔN296, N296N, N296H, ΔN298, P301L, P301S, P301T, G303V, G304S, S305I, S305N, and S305S in E10; L315R, K317M, S320F, P332S in E11; G335S, G335V, Q336R, V337M, E342V, S352L, S356T, V363I, P364S, G366R, and K369I in E12; G389R, R406W, and T427M in E13 of the MAPT gene. MAPT (tau) null (−/−) humans are likely non-viable. The MAPT heterozygote (+/−) humans have unclear or unknown phenotypes. The MAPT over-expressing (+/+/+) humans are associated with early onset dementia, FTD, PSP, and CBD.

Each of the six isoforms of the MAPT (tau) protein contains three or four repeated segments (R1, R2, R3, and R4) in its microtubule-binding domain. Each repeat is 31 or 32 amino acids in length. Splicing of E9, E10, E11, and E12 gives rise to the R1, R2, R3, and R4, respectively, of the repeated segments in the MAPT's microtubule-binding domain. Three MAPT (tau) isoforms, in which E10 is spliced in, contain four repeated segments (4R), whereas the other three MAPT isoforms, in which E10 is spliced out, contain three repeated segments (3R).

Translation of E2 and E3 give rise to the N1 and N2 segments, respectively. Alternative splicing of E2 and E3 gives rise to tau isoforms 0N (E2 and E3 are spliced out, resulting in no N segment), 1N (E2 is spliced in and E3 is spliced out, resulting in one N segment), and 2N (E2 and E3 are spliced in, resulting in two N segments). Accordingly, the six MAPT (tau) isoforms resulting from alternative splicing are 2N4R, 1N4R, 0N4R, 2N3R, 1N3R, and 0N3R.

In healthy individuals, the 3R and 4R MAPT transcript isoforms exist in 1:1 ratio. The 3R/4R isoform ratio is skewed in disease states and the ratio predicts the tau aggregate type. The assembly of four-repeat tau into filaments is characteristic of PSP, CBD, argyrophilic grain disease (AGD), multiple system tauopathy with presenile dementia (MSTD), and white matter tauopathy with globular glial inclusions (FTD with GGIs), which belong to the FTD spectrum (4R tauopathy). In contrast, in Pick's disease, three-repeat tau predominates in the neuronal inclusions (3R tauopathy). In Alzheimer's disease, or other neurodegenerative diseases with neurofibrillary tangles (NFT dementia), both three- and four-repeat tau isoforms make up the neurofibrillary lesions (3/4R tauopathy). FTLD with MAPT mutations can be 3R, 4R, or 3/4R tauopathy.

FTD with motor neuron disease is associated with the FTLD-TDP43 and FTLD-FUS pathology. It is associated with gene mutations of C90RF72, FUS, TARDBP, and VCP.

bvFTD is associated with the FTLD-Tau (3R) and FTLD-TDP43 pathology. Ten percent of the cases involve MAPT mutation. It is associated with gene mutations of C90RF72, GRN, and VCP.

PPA-S may be sporadic. It is associated with the FTLD-TDP43 pathology.

nfvPPA is associated with the FTLD-Tau (4R), Alzheimer's disease, and FTLD-TDP43 pathology, in the order of significance. Ten percent of the cases involve MAPT mutation. nfvPPA is further associated with mutations of GRN.

PPA-L may be sporadic. It is associated with the Alzheimer's disease and FTLD-Tau pathology, in the order of significance.

CBS is associated with the FTLD-Tau (4R) and Alzheimer's disease pathology, in the order of significance. Ten percent of the case is associated with MAPT mutation. The rest of the cases may be sporadic.

PSP involves FTLD-Tau (4R) pathology. Ten percent of the case is associated with MAPT mutation. The rest of the cases may be sporadic.

Tauopathy generally starts at age 60-80 years, and affects the remaining lifespan of 6-10 years. Tauopathies are phenotypically heterogeneous, with variable involvement of motor, cognitive, and behavioral impairment. In particular, progression of motor symptoms is variable.

There are currently no approved disease-modifying therapies for tauopathies. Available treatments are only aimed at alleviating the symptoms and improving the patient's quality of life as the disease progresses. Drugs in preclinical or clinical development include active and passive immunotherapies; inhibitors of O-deglycosylation, aggregation, kinases, acetylation, caspases or tau expression; phosphatase activators; microtubule stabilizers; and modulators of autophagy or proteosomal degradation. Biomarkers and testing used in clinical trials to assess tauopathy include tau protein phosphorylated at threonine 181 (pTau), total tau protein (tTau), neurofilament light chain (NfL), and volumetric MRI (vMRI).

Exemplary nucleotide and amino acid sequences of MAPT are found, for example, at GenBank Accession No. NM_016841.4 (*Homo sapiens* MAPT variant 4, SEQ ID NO: 1, reverse complement, SEQ ID NO: 2); GenBank Accession No. NM_005910 (*Homo sapiens* MAPT variant 2, SEQ ID NO: 3, reverse complement, SEQ ID NO: 4); GenBank Accession No. NM_001038609.2 (*Mus musculus* MAPT, SEQ ID NO: 5; reverse complement, SEQ ID NO: 6); GenBank Accession No.: XM_005584540.1 (*Macaca fascicularis* MAPT variant X13, SEQ ID NO: 7, reverse complement, SEQ ID NO: 8); GenBank Accession No.: XM_008768277.2 (*Rattus norvegicus* MAPT, variant X7, SEQ ID NO: 9, reverse complement, SEQ ID NO: 10) and GenBank Accession No.: XM_005624183.3 (*Canis lupus* MAPT variant X23, SEQ ID NO: 11, reverse complement, SEQ ID NO: 12).

The nucleotide sequence of the genomic region of human chromosome harboring the MAPT gene may be found in, for example, the Genome Reference Consortium Human Build 38 (also referred to as Human Genome build 38 or GRCh38) available at GenBank. The nucleotide sequence of the genomic region of human chromosome 17 harboring the MAPT gene may also be found at, for example, GenBank Accession No. NC_000017.11, corresponding to nucleotides 45894382-46028334 of human chromosome 17. The nucleotide sequence of the human MAPT gene may be found in, for example, GenBank Accession No. NG_007398.2

Further examples of MAPT sequences are found in publically available databases, for example, GenBank, OMIM, and UniProt.

Additional information on MAPT are found, for example, at the NCBI web site that refers to gene 100128977. The term MAPT as used herein also refers to variations of the MAPT gene including variants provided in the clinical variant database, for example, at the NCBI clinical variants web site that refers to the term mapt.

The entire contents of each of the foregoing GenBank Accession numbers and the Gene database numbers are incorporated herein by reference as of the date of filing this application.

As used herein, "target sequence" refers to a contiguous portion of the nucleotide sequence of an mRNA molecule formed during the transcription of a MAPT gene, including mRNA that is a product of RNA processing of a primary transcription product (e.g., MAPT mRNA resulting from alternate splicing). In one embodiment, the target portion of the sequence will be at least long enough to serve as a substrate for RNAi-directed cleavage at or near that portion of the nucleotide sequence of an mRNA molecule formed during the transcription of a MAPT gene.

The target sequence is about 15-30 nucleotides in length. For example, the target sequence are from about 15-30 nucleotides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. In certain embodiments, the target sequence is 19-23 nucleotides in length, optionally 21-23 nucleotides in length. Ranges and lengths intermediate to the above recited ranges and lengths are also contemplated to be part of the disclosure.

As used herein, the term "strand comprising a sequence" refers to an oligonucleotide comprising a chain of nucleotides that is described by the sequence referred to using the standard nucleotide nomenclature. "G," "C," "A," "T", and "U" each generally stand for a nucleotide that contains guanine, cytosine, adenine, thymidine, and uracil as a base, respectively in the context of a modified or unmodified nucleotide. However, it will be understood that the term "ribonucleotide" or "nucleotide" also refers to a modified nucleotide, as further detailed below, or a surrogate replacement moiety (see, e.g., Table 2). The skilled person is well aware that guanine, cytosine, adenine, thymidine, and uracil is replaced by other moieties without substantially altering the base pairing properties of an oligonucleotide comprising a nucleotide bearing such replacement moiety. For example, without limitation, a nucleotide comprising inosine as its base base pairs with nucleotides containing adenine, cytosine, or uracil. Hence, nucleotides containing uracil, guanine, or adenine is replaced in the nucleotide sequences of dsRNA featured in the disclosure by a nucleotide containing, for example, inosine. In another example, adenine and cytosine anywhere in the oligonucleotide is replaced with guanine and uracil, respectively to form G-U Wobble base pairing with the target mRNA. Sequences containing such replacement moieties are suitable for the compositions and methods featured in the disclosure.

The terms "iRNA", "RNAi agent," "iRNA agent," "RNA interference agent" as used interchangeably herein, refer to an agent that contains RNA as that term is defined herein, and which mediates the targeted cleavage of an RNA transcript via an RNA-induced silencing complex (RISC) pathway. RNA interference (RNAi) is a process that directs the sequence-specific degradation of mRNA. RNAi modulates, e.g., inhibits, the expression of MAPT in a cell, e.g., a cell within a subject, such as a mammalian subject.

In one embodiment, an RNAi agent of the disclosure includes a single stranded RNAi that interacts with a target RNA sequence, e.g., a MAPT target mRNA sequence, to direct the cleavage of the target RNA. Without wishing to be bound by theory it is believed that long double stranded RNA introduced into cells is broken down into double-stranded short interfering RNAs (siRNAs) comprising a sense strand and an antisense strand by a Type III endonuclease known as Dicer (Sharp et al. (2001) *Genes Dev.* 15:485). Dicer, a ribonuclease-III-like enzyme, processes this dsRNA into 19-23 base pair short interfering RNAs with characteristic two base 3' overhangs (Bernstein, et al., (2001) *Nature* 409:363). These siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the disclosure relates to a single stranded RNA (ssRNA) (the antisense strand of a siRNA duplex) generated within a cell and which promotes the formation of a RISC complex to effect silencing of the target gene, i.e., a MAPT gene. Accordingly, the term "siRNA" is also used herein to refer to an RNAi as described above.

In another embodiment, the RNAi agent may be a single-stranded RNA that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded RNAs are described in U.S. Pat. No. 8,101,348 and in Lima et al., (2012) *Cell* 150:883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In another embodiment, a "RNAi agent" for use in the compositions and methods of the disclosure is a double stranded RNA and is referred to herein as a "double stranded RNAi agent," "double stranded RNA (dsRNA) molecule," "dsRNA agent," or "dsRNA". The term "dsRNA" refers to a complex of ribonucleic acid molecules, having a duplex structure comprising two anti-parallel and substantially complementary nucleic acid strands, referred to as having "sense" and "antisense" orientations with respect to a target RNA, i.e., a MAPT gene. In some embodiments of the disclosure, a double stranded RNA (dsRNA) triggers the degradation of a target RNA, e.g., an mRNA, through a post-transcriptional gene-silencing mechanism referred to herein as RNA interference or RNAi.

In general, a dsRNA molecule includes ribonucleotides, but as described in detail herein, each or both strands include one or more non-ribonucleotides, e.g., a deoxyribonucleotide, a modified nucleotide. In addition, as used in this specification, an "RNAi agent" may include ribonucleotides with chemical modifications; an RNAi agent may include substantial modifications at multiple nucleotides. As used herein, the term "modified nucleotide" refers to a nucleotide having, independently, a modified sugar moiety, a modified internucleotide linkage, or a modified nucleobase. Thus, the term modified nucleotide encompasses substitutions, additions or removal of, e.g., a functional group or atom, to internucleoside linkages, sugar moieties, or nucleobases. The modifications suitable for use in the agents of the disclosure include all types of modifications disclosed herein or known in the art. Any such modifications, as used in a siRNA type molecule, are encompassed by "RNAi agent" for the purposes of this specification and claims.

In certain embodiments of the instant disclosure, inclusion of a deoxy-nucleotide if present within an RNAi agent is to be considered to constitute a modified nucleotide.

The duplex region may be of any length that permits specific degradation of a desired target RNA through a RISC pathway, and may range from about 15-36 base pairs in length, for example, about 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain embodiments, the duplex region is 19-21 base pairs in length, e.g., 21 base pairs in length. Ranges and lengths intermediate to the above recited ranges and lengths are also contemplated to be part of the disclosure.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop comprises at least one unpaired nucleotide. In some embodiments, the hairpin loop comprises at least 4, at least 5, at least 6, at least 7, at least 8, at least 9, at least 10, at least 20, at least 23 or more unpaired nucleotides or nucleotides not directed to the target site of the dsRNA. In some embodiments, the hairpin loop is 10 or fewer nucleotides. In some embodiments, the hairpin is 8 or fewer unpaired nucleotides. In some embodiments, the hairpin loop is 4-10 unpaired nucleotides. In some embodiments, the hairpin loop is 4-8 nucleotides.

Where the two substantially complementary strands of a dsRNA are comprised by separate RNA molecules, those molecules need not, but can be covalently connected. In certain embodiments where the two strands are connected covalently by means other than an uninterrupted chain of nucleotides between the 3'-end of one strand and the 5'-end of the respective other strand forming the duplex structure, the connecting structure is referred to as a "linker" (though it is noted that certain other structures defined elsewhere herein is to be referred to as a "linker"). The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs. In one embodiment of the RNAi agent, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In one embodiment, an RNAi agent of the disclosure is a dsRNA, each strand of which independently comprises 19-23 nucleotides, that interacts with a target RNA sequence, e.g., a MAPT target mRNA sequence, to direct the cleavage of the target RNA.

In some embodiments, an iRNA of the invention is a dsRNA of 24-30 nucleotides that interacts with a target RNA sequence, e.g., a MAPT target mRNA sequence, to direct the cleavage of the target RNA.

As used herein, the term "nucleotide overhang" refers to at least one unpaired nucleotide that protrudes from the duplex structure of an RNAi agent, e.g., a dsRNA. For example, when a 3'-end of one strand of a dsRNA extends beyond the 5'-end of the other strand, or vice versa, there is a nucleotide overhang. A dsRNA comprises an overhang of at least one nucleotide; alternatively, the overhang comprises at least two nucleotides, at least three nucleotides, at least four nucleotides, at least five nucleotides or more. A nucleotide overhang comprises or consists of a nucleotide/nucleoside analog, including a deoxynucleotide/nucleoside. The overhang(s) is on the sense strand, the antisense strand or any combination thereof. Furthermore, the nucleotide(s) of an overhang is present on the 5'-end, 3'-end or both ends of either an antisense or sense strand of a dsRNA.

In one embodiment, the antisense strand of a dsRNA has a 1-10 nucleotide, e.g., a 1, 2, 3, 4, 5, 6, 7, 8, 9, or 10 nucleotide overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide overhang at the 3'-end or the 5'-end. In another embodiment, one or more of the nucleotides in the overhang is replaced with a nucleoside thiophosphate.

In certain embodiments, the antisense strand of a dsRNA has a 1-10 nucleotide, e.g., 0-3, 1-3, 2-4, 2-5, 4-10, 5-10, e.g., a 1, 2, 3, 4, 5, 6, 7, 8, 9, or 10 nucleotide overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide overhang at the 3'-end or the 5'-end. In another embodiment, one or more of the nucleotides in the overhang is replaced with a nucleoside thiophosphate.

In certain embodiments, the overhang on the sense strand or the antisense strand, include extended lengths longer than 10 nucleotides, e.g., 1-30 nucleotides, 2-30 nucleotides, 10-30 nucleotides, or 10-15 nucleotides in length. In certain embodiments, an extended overhang is on the sense strand of the duplex. In certain embodiments, an extended overhang is present on the 3' end of the sense strand of the duplex. In certain embodiments, an extended overhang is present on the 5' end of the sense strand of the duplex. In certain embodiments, an extended overhang is on the antisense strand of the duplex. In certain embodiments, an extended overhang is present on the 3' end of the antisense strand of the duplex. In certain embodiments, an extended overhang is present on the 5' end of the antisense strand of the duplex. In certain embodiments, one or more of the nucleotides in the overhang is replaced with a nucleoside thiophosphate. In certain embodiments, the overhang includes a self-complementary portion such that the overhang is capable of forming a hairpin structure that is stable under physiological conditions.

The terms "blunt" or "blunt ended" as used herein in reference to a dsRNA mean that there are no unpaired nucleotides or nucleotide analogs at a given terminal end of a dsRNA, i.e., no nucleotide overhang. One or both ends of a dsRNA are blunt. Where both ends of a dsRNA are blunt, the dsRNA is said to be blunt ended. To be clear, a "blunt ended" dsRNA is a dsRNA that is blunt at both ends, i.e., no nucleotide overhang at either end of the molecule. Most often such a molecule will be double stranded over its entire length.

The term “antisense strand” or “guide strand” refers to the strand of an RNAi agent, e.g., a dsRNA, which includes a region that is substantially complementary to a target sequence, e.g., a MAPT mRNA.

As used herein, the term “region of complementarity” refers to the region on the antisense strand that is substantially complementary to a sequence, for example a target sequence, e.g., a MAPT nucleotide sequence, as defined herein. Where the region of complementarity is not fully complementary to the target sequence, the mismatches is in the internal or terminal regions of the molecule. Generally, the most tolerated mismatches are in the terminal regions, e.g., within 5, 4, 3, or 2 nucleotides of the 5'- or 3'-terminus of the RNAi agent. In some embodiments, a double stranded RNA agent of the invention includes a nucleotide mismatch in the antisense strand. In some embodiments, the antisense strand of the double stranded RNA agent of the invention includes no more than 4 mismatches with the target mRNA, e.g., the antisense strand includes 4, 3, 2, 1, or 0 mismatches with the target mRNA. In some embodiments, the antisense strand double stranded RNA agent of the invention includes no more than 4 mismatches with the sense strand, e.g., the antisense strand includes 4, 3, 2, 1, or 0 mismatches with the sense strand. In some embodiments, a double stranded RNA agent of the invention includes a nucleotide mismatch in the sense strand. In some embodiments, the sense strand of the double stranded RNA agent of the invention includes no more than 4 mismatches with the antisense strand, e.g., the sense strand includes 4, 3, 2, 1, or 0 mismatches with the antisense strand. In some embodiments, the nucleotide mismatch is, for example, within 5, 4, 3 nucleotides from the 3'-end of the iRNA. In another embodiment, the nucleotide mismatch is, for example, in the 3'-terminal nucleotide of the iRNA agent. In some embodiments, the mismatch(s) is not in the seed region.

Thus, an RNAi agent as described herein contains one or more mismatches to the target sequence. In one embodiment, an RNAi agent as described herein contains no more than 3 mismatches (i.e., 3, 2, 1, or 0 mismatches). In one embodiment, an RNAi agent as described herein contains no more than 2 mismatches. In one embodiment, an RNAi agent as described herein contains no more than 1 mismatch. In one embodiment, an RNAi agent as described herein contains 0 mismatches. In certain embodiments, if the antisense strand of the RNAi agent contains mismatches to the target sequence, the mismatch optionally is restricted to be within the last 5 nucleotides from either the 5'- or 3'-end of the region of complementarity. For example, in such embodiments, for a 23 nucleotide RNAi agent, the strand which is complementary to a region of a MAPT gene, generally does not contain any mismatch within the central 13 nucleotides. The methods described herein or methods known in the art are used to determine whether an RNAi agent containing a mismatch to a target sequence is effective in inhibiting the expression of a MAPT gene. For example, Jackson et al. (*Nat. Biotechnol.* 2003; 21: 635-637) described an expression profile study where the expression of a small set of genes with sequence identity to the MAPK14 siRNA only at 12-18 nt of the sense strand, was down-regulated with similar kinetics to MAPK14. Similarly, Lin et al., (*Nucleic Acids Res.* 2005; 33(14): 4527-4535) using qPCR and reporter assays, showed that a 7 nt complementation between a siRNA and a target is sufficient to cause mRNA degradation of the target. Consideration of the efficacy of RNAi agents with mismatches in inhibiting expression of a MAPT gene is important, especially if the particular region of complementarity in a MAPT gene is known to have polymorphic sequence variation within the population.

As used herein, “substantially all of the nucleotides are modified” are largely but not wholly modified and include not more than 5, 4, 3, 2, or 1 unmodified nucleotide.

The term “sense strand” or “passenger strand” as used herein, refers to the strand of an RNAi agent that includes a region that is substantially complementary to a region of the antisense strand as that term is defined herein.

As used herein, the term “cleavage region” refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term “complementary,” when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions are, for example, “stringent conditions”, including but not limited to, 400 mM NaCl, 40 mM PIPES pH 6.4, 1 mM EDTA, 50° C. or 70° C. for 12-16 hours followed by washing (see, e.g., “Molecular Cloning: A Laboratory Manual, Sambrook, et al. (1989) Cold Spring Harbor Laboratory Press). As used herein, “stringent conditions” or “stringent hybridization conditions” refers to conditions under which an antisense compound will hybridize to its target sequence, but to a minimal number of other sequences. Stringent conditions are sequence-dependent and will be different in different circumstances, and “stringent conditions” under which antisense compounds hybridize to a target sequence are determined by the nature and composition of the antisense compounds and the assays in which they are being investigated. Other conditions, such as physiologically relevant conditions as encountered inside an organism, apply. The skilled person will be able to determine the set of conditions most appropriate for a test of complementarity of two sequences in accordance with the ultimate application of the hybridized nucleotides.

Complementary sequences within an RNAi agent, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences are referred to as “fully complementary” with respect to each other herein. However, where a first sequence is referred to as “substantially complementary” with respect to a second sequence herein, the two sequences are fully complementary, or they form one or more, but generally not more than 5, 4, 3 or 2 mismatched base pairs upon hybridization for a duplex up to 30 base pairs. In some embodiments, the “substantially complementary” sequences disclosed herein comprise a contiguous nucleotide sequence which is at least about 80% complementary over its entire length to the equivalent region of the target MAPT sequence, such as about 85%, about 90%, about 91%, about 92%, about 93%, about 94%, about 95%, about 96%, about 97%, about 98%, or about 99% complementary. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, are referred to as "fully complementary" for the purposes described herein.

"Complementary" sequences, as used herein, also include, or be formed entirely from, non-Watson-Crick base pairs or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially complementary" herein are used with respect to the base matching between the sense strand and the antisense strand of a dsRNA, or between the antisense strand of an RNAi agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding Tau). For example, a polynucleotide is complementary to at least a part of a MAPT mRNA if the sequence is substantially complementary to a non-interrupted portion of an mRNA encoding Tau.

Accordingly, in some embodiments, the antisense polynucleotides disclosed herein are fully complementary to the target MAPT sequence. In other embodiments, the antisense polynucleotides disclosed herein are substantially complementary to the target MAPT sequence and comprise a contiguous nucleotide sequence which is at least 80% complementary over its entire length to the equivalent region of the nucleotide sequence of any one of SEQ ID NOs:1, 3, 5, 7, 9 and 11, or a fragment of any one of SEQ ID NOs:1, 3, 5, 7, 9 and 11, such as about 85%, about 90%, about 91%, about 92%, about 93%, about 94%, about 95%, about 96%, about 97%, about 98%, or about 99% complementary.

In some embodiments, the antisense polynucleotides disclosed herein are substantially complementary to a fragment of a target MAPT sequence and comprise a contiguous nucleotide sequence which is at least 80% complementary over its entire length to a fragment of SEQ ID NO: 1 selected from the group of nucleotides 506-526, 507-527, 508-528, 509-529, 510-530, 511-531, 512-532, 513-533, 514-534, 515-535, 516-536, 517-537, 518-538, 519-539, 520-540, 521-541, 522-542, 523-543, 524-544, 525-545, 526-544, 526-546, 527-547, 528-548, 529-549, 530-550, 531-551, 532-552, 533-553, 969-989, 970-990, 971-991, 972-992, 973-993, 974-994, 975-995, 976-996, 977-997, 978-997, 978-998, 979-997, 979-999, 980-1000, 981-1001, 982-1002, 983-1003, 984-1004, 985-1003, 985-1005, 986-1006, 987-1007, 988-1008, 989-1009, 990-1010, 1069-1089, 1070-1090, 1071-1091, 1072-1092, 1073-1093, 1074-1094, 1075-1095, 1076-1096, 1077-1095, 1077-1097, 1078-1098, 1079-1099, 1080-1100, 1081-1101, 5511-5531, 5512-5532, 5513-5533, 5514-5534, 5515-5535, 5516-5536, 5517-5537, 5518-5538, 5519-5539, 5520-5540, 5521-5541, 5522-5542, and 5523-5543 of SEQ ID NO: 1, such as about 85%, about 90%, about 91%, about 92%, about 93%, about 94%, about 95%, about 96%, about 97%, about 98%, or about 99% complementary. Ranges intermediate to the above recited ranges are also contemplated to be part of the disclosure.

In some embodiments, the antisense polynucleotides disclosed herein are substantially complementary to a fragment of a target MAPT sequence and comprise a contiguous nucleotide sequence which is at least 80% complementary over its entire length to a fragment of SEQ ID NO: 3 selected from the group of nucleotides 1072-1092, 1067-1087, and 514-534 of SEQ ID NO: 3, such as about 85%, about 90%, about 91%, about 92%, about 93%, about 94%, about 95%, about 96%, about 97%, about 98%, or about 99% complementary. Ranges intermediate to the above recited ranges are also contemplated to be part of the disclosure.

In other embodiments, the antisense polynucleotides disclosed herein are substantially complementary to the target MAPT sequence and comprise a contiguous nucleotide sequence which is at least about 80% complementary over its entire length to any one of the sense strand nucleotide sequences in any one of any one of Tables 3-6, or a fragment of any one of the sense strand nucleotide sequences in any one of Tables 3-6, such as about 85%, about 90%, about 91%, about 92%, about 93%, about 94%, about 95%, about 96%, about 97%, about 98%, about 99%, or 100% complementary.

In one embodiment, an RNAi agent of the disclosure includes a sense strand that is substantially complementary to an antisense polynucleotide which, in turn, is the same as a target MAPT sequence, and wherein the sense strand polynucleotide comprises a contiguous nucleotide sequence which is at least about 80% complementary over its entire length to the equivalent region of the nucleotide sequence of SEQ ID NOs:1, 3, 5, 7, 9 and 11, or a fragment of any one of SEQ ID NOs: 1, 3, 5, 7, 9 and 11, such as about 85%, about 90%, about 91%, about 92%, about 93%, about 94%, about 95%, about 96%, about 97%, about 98%, about 99%, or 100% complementary.

In some embodiments, an iRNA of the invention includes a sense strand that is substantially complementary to an antisense polynucleotide which, in turn, is complementary to a target MAPT sequence, and wherein the sense strand polynucleotide comprises a contiguous nucleotide sequence which is at least about 80% complementary over its entire length to any one of the antisense strand nucleotide sequences in any one of Tables 3-6, or a fragment of any one of the antisense strand nucleotide sequences in any one of Tables 3-6, such as about 85%, about 90%, about 91%, about 92%, about 93%, about 94%, about 95%, about 96%, about 97%, about 98%, about 99%, or 100% complementary.

In certain embodiments, the sense and antisense strands are selected from any one of duplexes AD-1397070, AD-1397072, AD-1397073, AD-1397075, AD-1397081, AD-1397083, AD-1397088, AD-1397249, AD-1397252, AD-1397253, AD-1397258, AD-1397261, AD-1397262, AD-1397263, AD-1397291, AD-1397293, AD-1397294, AD-1397295, AD-1397298, AD-1397299, AD-1637732, AD-1637733, AD-1637734, AD-1637735, AD-1637736, AD-1637737, AD-1637739, AD-1637744, AD-1637745, AD-1637746, AD-1637747, AD-1637748, AD-1637749, AD-1637750, AD-1637751, AD-1637752, AD-1637753, AD-1637754, AD-1637755, AD-1637756, AD-1637757, AD-1637758, AD-1637759, AD-1637760, AD-1637761, AD-1637762, AD-1637763, AD-1637764, AD-1637765, AD-1637766, AD-1637767, AD-1637768, AD-1637769, AD-1637770, AD-1637771, AD-1637772, AD-1637773, AD-1637774, AD-1637775, AD-1637776, AD-1637777, AD-1637778, AD-1637779, AD-1637780, AD-1637781, AD-1637782, AD-1637783, AD-1637784, AD-1637785, AD-1637786, AD-1637787, AD-1637788, AD-1637789, AD-1637790, AD-1637791, AD-1637792, AD-1637793, AD-1637794, AD-1637795, AD-1637796, AD-1637797, AD-1637798, AD-1637799, AD-1637800, AD-1637801, AD-1637802, AD-1637803, AD-1637804, AD-1637805, AD-1637806, AD-1637807, AD-1637808, AD-1637809, AD-1637810, AD-1637811, AD-1637812, AD-1637813, AD-1637814, AD-1637815, AD-1637816, AD-1637817, AD-1637818, AD-1637819, AD-1637820, AD-1637821, AD-1637822, AD-1637823, AD-1637824, AD-1637825, AD-1637826, AD-1637827, AD-1637828, AD-1637829, AD-1637830, AD-1637831, AD-1637832, AD-1637833, AD-1637834, AD-1637835, AD-1637836, AD-1637837, AD-1637838, AD-1637839, AD-1637840, AD-1637841, AD-1637842, AD-1637843, AD-1637844, AD-1637845, AD-1637846, AD-1637847, AD-1637848, AD-1637849, AD-1637850, AD-1637851, AD-1637852, AD-1637853, AD-1637854, AD-1637855, AD-1637856, AD-1637857, AD-1637858, AD-1637859, AD-1637860, AD-1637861, AD-1637862, AD-1637863, AD-1637864, AD-1637865, AD-1637866, AD-1637867, AD-1637868, AD-1637869, AD-1637870, AD-1637871, AD-1637872, AD-1637873, AD-1637874, AD-1637875, AD-1637876, AD-1637877, AD-1637878, AD-1637879, AD-1637880, AD-1637881, AD-1637882, AD-1637883, AD-1637884, AD-1637885, AD-1637886, AD-1637887, AD-1637888, AD-1637889, AD-1637890, AD-1637891, AD-1637892, AD-1637893, AD-1637894, AD-1637895, AD-1637896, AD-1637897, AD-1637898, AD-1637899, AD-1637900, AD-1637901, AD-1637902, AD-1637903, AD-1637904, AD-1637905, AD-1637906, AD-1637907, AD-1637908, AD-1637909, AD-1637910, AD-1637911, AD-1637912, AD-1637913, AD-1637914, AD-1637915, AD-1637916, AD-1637917, AD-1637918, AD-1637919, AD-1637920, AD-1637921, AD-1637922, AD-1637923, AD-1637924, AD-1637925, AD-1637926, AD-1637927, AD-1637928, AD-1637929, AD-1637930, AD-1637931, AD-1637932, AD-1637933, AD-1637934, AD-1637935, AD-1637936, AD-1637937, AD-1637938, AD-1637939, AD-1637940, AD-1637941, AD-1637942, AD-1637943, AD-1637944, AD-1637945, AD-1637946, AD-1637947, AD-1637948, AD-1637949, AD-1637950, AD-1637951, AD-1637952, AD-1637953, AD-1637954, AD-1637955, AD-1637956, AD-1637957, AD-1637958, AD-1637959, AD-1637960, AD-397167, AD-523565, AD-1623140, AD-1637701, AD-1786708, and AD-1786708v2. In certain specific embodiments, the sense and antisense strands are selected from any one of duplexes AD-1637922, AD-1637806, AD-1637762, AD-1637777, AD-1637779, AD-1397081, AD-1637793, AD-1637798, AD-1637807, AD-1637829, AD-1637831, AD-1637840, AD-1637841, AD-1637855, AD-1637883, and AD-1637884. In certain embodiments, the duplex is selected from the group consisting of AD-1623140, AD-1786708, and AD-1637701. In certain embodiments, the duplex is AD-1623140. In certain embodiments, the duplex is AD-1786708. In certain embodiments, the duplex is AD-1786708.

In one embodiment, at least partial suppression of the expression of a MAPT gene, is assessed by a reduction of the amount of MAPT mRNA, e.g., sense mRNA, antisense mRNA, total MAPT mRNA, which is isolated from or detected in a first cell or group of cells in which a MAPT gene is transcribed and which has or have been treated such that the expression of a MAPT gene is inhibited, as compared to a second cell or group of cells substantially identical to the first cell or group of cells but which has or have not been so treated (control cells). The degree of inhibition may be expressed in terms of:

$$\frac{(mRNA \text{ in control cells}) - (mRNA \text{ in treated cells})}{(mRNA \text{ in control cells})} \times 100$$

The phrase "contacting a cell with an RNAi agent," such as a dsRNA, as used herein, includes contacting a cell by any possible means. Contacting a cell with an RNAi agent includes contacting a cell in vitro with the RNAi agent or contacting a cell in vivo with the RNAi agent. The contacting may be done directly or indirectly. Thus, for example, the RNAi agent may be put into physical contact with the cell by the individual performing the method, or alternatively, the RNAi agent may be put into a situation that will permit or cause it to subsequently come into contact with the cell.

Contacting a cell in vitro may be done, for example, by incubating the cell with the RNAi agent. Contacting a cell in vivo may be done, for example, by injecting the RNAi agent into or near the tissue where the cell is located, or by injecting the RNAi agent into another area, e.g., the CNS, optionally via intrathecal, intravitreal, intracisternal or other injection, or to the bloodstream or the subcutaneous space, such that the agent will subsequently reach the tissue where the cell to be contacted is located. For example, the RNAi agent may contain or be coupled to a ligand, e.g., a lipophilic moiety or moieties as described below and further detailed, e.g., in PCT/US2019/031170, which is incorporated herein by reference, that directs or otherwise stabilizes the RNAi agent at a site of interest, e.g., the CNS. Combinations of in vitro and in vivo methods of contacting are also possible. For example, a cell may also be contacted in vitro with an RNAi agent and subsequently transplanted into a subject.

In one embodiment, contacting a cell with an RNAi agent includes "introducing" or "delivering the RNAi agent into the cell" by facilitating or effecting uptake or absorption into the cell. Absorption or uptake of an RNAi agent occurs through unaided diffusive or active cellular processes, or by auxiliary agents or devices. Introducing an RNAi agent into a cell may be in vitro or in vivo. For example, for in vivo introduction, an RNAi agent is injected into a tissue site or administered systemically. In vitro introduction into a cell includes methods known in the art such as electroporation and lipofection. Further approaches are described herein below or are known in the art.

The term "lipophile" or "lipophilic moiety" broadly refers to any compound or chemical moiety having an affinity for lipids. One way to characterize the lipophilicity of the lipophilic moiety is by the octanol-water partition coefficient, log $K_{ow}$, where $K_{ow}$ is the ratio of a chemical's concentration in the octanol-phase to its concentration in the aqueous phase of a two-phase system at equilibrium. The octanol-water partition coefficient is a laboratory-measured property of a substance. However, it may also be predicted by using coefficients attributed to the structural components of a chemical which are calculated using first-principle or empirical methods (see, for example, Tetko et al., *J Chem. Inf. Comput. Sci.* 41:1407-21 (2001), which is incorporated herein by reference in its entirety). It provides a thermodynamic measure of the tendency of the substance to prefer a non-aqueous or oily milieu rather than water (i.e. its hydrophilic/lipophilic balance). In principle, a chemical substance is lipophilic in character when its log $K_{ow}$ exceeds 0. Typically, the lipophilic moiety possesses a log $K_{ow}$ exceeding 1, exceeding 1.5, exceeding 2, exceeding 3, exceeding 4, exceeding 5, or exceeding 10. For instance, the log $K_{ow}$ of 6-amino hexanol, for instance, is predicted to be approximately 0.7. Using the same method, the log $K_{ow}$ of cholesteryl N-(hexan-6-ol) carbamate is predicted to be 10.7.

The lipophilicity of a molecule changes with respect to the functional group it carries. For instance, adding a hydroxyl group or amine group to the end of a lipophilic moiety can increase or decrease the partition coefficient (e.g., log $K_{ow}$) value of the lipophilic moiety.

Alternatively, the hydrophobicity of the double-stranded RNAi agent, conjugated to one or more lipophilic moieties, is measured by its protein binding characteristics. For instance, in certain embodiments, the unbound fraction in the plasma protein binding assay of the double-stranded RNAi agent could be determined to positively correlate to the relative hydrophobicity of the double-stranded RNAi agent, which could then positively correlate to the silencing activity of the double-stranded RNAi agent.

In one embodiment, the plasma protein binding assay determined is an electrophoretic mobility shift assay (EMSA) using human serum albumin protein. An exemplary protocol of this binding assay is illustrated in detail in, e.g., PCT/US2019/031170. Briefly, duplexes were incubated with human serum albumin and the unbound fraction was determined. Exemplary assay protocol includes duplexes at a stock concentration of 10 μM, diluted to a final concentration of 0.5 μM (20 μL total volume) containing 0, 20, or 90% serum in 1×PBS. The samples are mixed, centrifuged for 30 seconds, and subsequently incubated at room temperature for 10 minutes. Once incubation step is completed, 4 μL of 6×EMSA Gel-loading solution is added to each sample, centrifuged for 30 seconds, and 12 μL of each sample is loaded onto a 26 well BioRad 10% PAGE (polyacrylamide gel electrophoresis). The gel is run for 1 hour at 100 volts. After completion of the run, the gel is removed from the casing and washed in 50 mL of 10% TBE (Tris base, boric acid and EDTA). Once washing is complete, 5 μL of SYBR Gold is added to the gel, which is then allowed to incubate at room temperature for 10 minutes, and the gel-washed again in 50 mL of 10% TBE. In this exemplary assay, a Gel Doc XR+ gel documentation system may be used to read the gel using the following parameters: the imaging application set to SYBR Gold, the size set to Bio-Rad criterion gel, the exposure set to automatic for intense bands, the highlight saturated pixels may be turned one and the color is set to gray. The detection, molecular weight analysis, and output are all disabled. Once a clean photo of the gel is obtained Image Lab 5.2 may be used to process the image. The lanes and bands are manually set to measure band intensity. Band intensities of each sample are normalized to PBS to obtain the fraction of unbound siRNA. From this measurement relative hydrophobicity are determined. The hydrophobicity of the double-stranded RNAi agent, measured by fraction of unbound siRNA in the binding assay, exceeds 0.15, exceeds 0.2, exceeds 0.25, exceeds 0.3, exceeds 0.35, exceeds 0.4, exceeds 0.45, or exceeds 0.5 for an enhanced in vivo delivery of siRNA.

Accordingly, conjugating the lipophilic moieties to the internal position(s) of the double-stranded RNAi agent provides optimal hydrophobicity for the enhanced in vivo delivery of siRNA.

The term "lipid nanoparticle" or "LNP" is a vesicle comprising a lipid layer encapsulating a pharmaceutically active molecule, such as a nucleic acid molecule, e.g., a RNAi agent or a plasmid from which an RNAi agent is transcribed. LNPs are described in, for example, U.S. Pat. Nos. 6,858,225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), or a non-primate (such as a rat, or a mouse). In a preferred embodiment, the subject is a human, such as a human being treated or assessed for a disease, disorder, or condition that would benefit from reduction in MAPT expression; a human at risk for a disease, disorder, or condition that would benefit from reduction in MAPT expression; a human having a disease, disorder, or condition that would benefit from reduction in MAPT expression; or human being treated for a disease, disorder, or condition that would benefit from reduction in MAPT expression as described herein. In some embodiments, the subject is a female human. In other embodiments, the subject is a male human. In one embodiment, the subject is an adult subject. In one embodiment, the subject is a pediatric subject. In another embodiment, the subject is a juvenile subject, i.e., a subject below 20 years of age.

As used herein, the terms "treating" or "treatment" refer to a beneficial or desired result including, but not limited to, alleviation or amelioration of one or more signs or symptoms associated with MAPT gene expression or Tau production in MAPT-associated diseases, such as Alzheimer's disease, FTD, PSP, or other tauopathies. "Treatment" also means prolonging survival as compared to expected survival in the absence of treatment.

The term "lower" in the context of the level of MAPT in a subject or a disease marker or symptom refers to a statistically significant decrease in such level. The decrease is, for example, at least 10%, 15%, 20%, 25%, 30%, %, 40%, 45%, 50%, 55%, 60%, 65%, 70%, 75%, 80%, 85%, 90%, 95%, or more. In certain embodiments, a decrease is at least 20%. In certain embodiments, the decrease is at least 50% in a disease marker, e.g., the level of sense- or anti-sense-containing foci and/or the level of aberrant dipeptide repeat protein, e.g., a decrease of 50%, 55%, 60%, 65%, 70%, 75%, 80%, 85%, 90%, 95%, or more. In some embodiments, a decrease is at least about 25% in a disease marker, e.g., Tau protein and/or gene expression level is decreased by, e.g., at least about 25%, at least about 30%, at least about 40%, at least about 50%, at least about 60%, at least about 70%, at least about 80%, at least about 90%, or at least about 95%. "Lower" in the context of the level of MAPT in a subject is preferably down to a level accepted as within the range of normal for an individual without such disorder. In certain embodiments, "lower" is the decrease in the difference between the level of a marker or symptom for a subject suffering from a disease and a level accepted within the range of normal for an individual, e.g., the level of decrease in bodyweight between an obese individual and an individual having a weight accepted within the range of normal.

As used herein, "prevention" or "preventing," when used in reference to a disease, disorder, or condition thereof, that would benefit from a reduction in expression of a MAPT gene or production of a Tau, refers to a reduction in the likelihood that a subject will develop a symptom associated with such a disease, disorder, or condition, e.g., a symptom of a MAPT-associated disease. The failure to develop a disease, disorder, or condition, or the reduction in the development of a symptom associated with such a disease, disorder, or condition (e.g., by at least about 10% on a clinically accepted scale for that disease or disorder), or the exhibition of delayed symptoms delayed (e.g., by days, weeks, months or years) is considered effective prevention.

As used herein, the term "MAPT-associated disease" or "MAPT-associated disorder" or "tauopathy" includes any disease or disorder that would benefit from reduction in the expression and/or activity of MAPT. Exemplary MAPT-associated diseases include Alzheimer disease, frontotemporal dementia (FTD), behavioral variant frontotemporal dementia (bvFTD), nonfluent variant primary progressive aphasia (nfvPPA), primary progressive aphasia-semantic (PPA-S), primary progressive aphasia-logopenic (PPA-L), frontotemporal dementia with parkinsonism linked to chromosome 17 (FTDP-17), Pick's disease (PiD), argyrophilic grain disease (AGD), multiple system tauopathy with presenile dementia (MSTD), white matter tauopathy with globular glial inclusions (FTLD with GGIs), FTLD with MAPT mutations, neurofibrillary tangle (NFT) dementia, FTD with motor neuron disease, amyotrophic lateral sclerosis (ALS), corticobasal syndrome (CBS), corticobasal degeneration (CBD), progressive supranuclear palsy (PSP), Parkinson's disease, postencephalitic Parkinsonism, Niemann-Pick disease, Huntington disease, type 1 myotonic dystrophy, and Down syndrome (DS).

"Therapeutically effective amount," as used herein, is intended to include the amount of an RNAi agent that, when administered to a subject having a MAPT-associated disease, is sufficient to effect treatment of the disease (e.g., by diminishing, ameliorating, or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of an RNAi agent that, when administered to a subject having a MAPT-associated disorder, is sufficient to prevent or ameliorate the disease or one or more symptoms of the disease. Ameliorating the disease includes slowing the course of the disease or reducing the severity of later-developing disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylactically effective amount" also includes an amount of an RNAi agent that produces some desired local or systemic effect at a reasonable benefit/risk ratio applicable to any treatment. An RNAi agent employed in the methods of the present disclosure may be administered in a sufficient amount to produce a reasonable benefit/risk ratio applicable to such treatment.

The phrase "pharmaceutically acceptable" is employed herein to refer to those compounds (including salts), materials, compositions, or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Some examples of materials which serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates or polyanhydrides; (22) bulking agents, such as polypeptides and amino acids (23) serum component, such as serum albumin, HDL and LDL; and (22) other non-toxic compatible substances employed in pharmaceutical formulations.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs or localized regions. For example, samples may be derived from particular organs, parts of organs, or fluids or cells within those organs. In certain embodiments, samples may be derived from the brain (e.g., whole brain or certain segments of brain, e.g., striatum, or certain types of cells in the brain, such as, e.g., neurons and glial cells (astrocytes, oligodendrocytes, microglial cells)). In some embodiments, a "sample derived from a subject" refers to blood drawn from the subject or plasma or serum derived therefrom. In further embodiments, a "sample derived from a subject" refers to brain tissue (or subcomponents thereof) or retinal tissue (or subcomponents thereof) derived from the subject.

The term "substituted" refers to the replacement of one or more hydrogen radicals in a given structure with the radical of a specified substituent including, but not limited to: alkyl, alkenyl, alkynyl, aryl, heterocyclyl, halo, thiol, alkylthio, arylthio, alkylthioalkyl, arylthioalkyl, alkylsulfonyl, alkylsulfonylalkyl, arylsulfonylalkyl, alkoxy, aryloxy, aralkoxy, aminocarbonyl, alkylaminocarbonyl, arylaminocarbonyl, alkoxycarbonyl, aryloxycarbonyl, haloalkyl, amino, trifluoromethyl, cyano, nitro, alkylamino, arylamino, alkylaminoalkyl, arylaminoalkyl, aminoalkylamino, hydroxy, alkoxyalkyl, carboxyalkyl, alkoxycarbonylalkyl, aminocarbonylalkyl, acyl, aralkoxycarbonyl, carboxylic acid, sulfonic acid, sulfonyl, phosphonic acid, aryl, heteroaryl, heterocyclic, and aliphatic. It is understood that the substituent is further substituted.

The term "alkyl" refers to saturated and unsaturated non-aromatic hydrocarbon chains that may be a straight chain or branched chain, containing the indicated number of carbon atoms (these include without limitation propyl, allyl, or propargyl), which may be optionally inserted with N, O, or S. For example, "(C1-C6) alkyl" means a radical having from 1 6 carbon atoms in a linear or branched arrangement. "(C1-C6) alkyl" includes, for example, methyl, ethyl, propyl, iso-propyl, n-butyl, tert-butyl, pentyl and hexyl. In certain embodiments, a lipophilic moiety of the instant disclosure includes a C6-C18 alkyl hydrocarbon chain.

The term "alkylene" refers to an optionally substituted saturated aliphatic branched or straight chain divalent hydrocarbon radical having the specified number of carbon atoms. For example, "(C1-C6) alkylene" means a divalent saturated aliphatic radical having from 1-6 carbon atoms in a linear arrangement, e.g., $[(CH_2)_n]$, where n is an integer from 1 to 6. "(C1-C6) alkylene" includes methylene, ethylene, propylene, butylene, pentylene and hexylene. Alternatively, "(C1-C6) alkylene" means a divalent saturated radical having from 1-6 carbon atoms in a branched arrangement, for example: $[(CH_2CH_2CH_2CH_2CH(CH_3)]$, $[(CH_2CH_2CH_2CH_2C(CH_3)_2]$, $[(CH_2C(CH_3)_2CH(CH_3))]$, and the like. The term "alkylenedioxo" refers to a divalent species of the structure —O—R—O—, in which R represents an alkylene.

The term "mercapto" refers to an —SH radical. The term "thioalkoxy" refers to an —S— alkyl radical.

The term "halo" refers to any radical of fluorine, chlorine, bromine or iodine. "Halogen" and "halo" are used interchangeably herein.

As used herein, the term "cycloalkyl" means a saturated or unsaturated nonaromatic hydrocarbon ring group having from 3 to 14 carbon atoms, unless otherwise specified. For example, "(C3-C10) cycloalkyl" means a hydrocarbon radical of a (3-10)-membered saturated aliphatic cyclic hydrocarbon ring. Examples of cycloalkyl groups include, but are not limited to, cyclopropyl, methyl-cyclopropyl, 2,2-dimethyl-cyclobutyl, 2-ethyl-cyclopentyl, cyclohexyl, etc. Cycloalkyls may include multiple spiro- or fused rings. Cycloalkyl groups are optionally mono-, di-, tri-, tetra-, or penta-substituted on any position as permitted by normal valency.

As used herein, the term "alkenyl" refers to a non-aromatic hydrocarbon radical, straight or branched, containing at least one carbon-carbon double bond, and having from 2 to 10 carbon atoms unless otherwise specified. Up to five carbon-carbon double bonds may be present in such groups. For example, "C2-C6" alkenyl is defined as an alkenyl radical having from 2 to 6 carbon atoms. Examples of alkenyl groups include, but are not limited to, ethenyl, propenyl, butenyl, and cyclohexenyl. The straight, branched, or cyclic portion of the alkenyl group may contain double bonds and is optionally mono-, di-, tri-, tetra-, or penta-substituted on any position as permitted by normal valency. The term "cycloalkenyl" means a monocyclic hydrocarbon group having the specified number of carbon atoms and at least one carbon-carbon double bond.

As used herein, the term "alkynyl" refers to a hydrocarbon radical, straight or branched, containing from 2 to 10 carbon atoms, unless otherwise specified, and containing at least one carbon-carbon triple bond. Up to 5 carbon-carbon triple bonds may be present. Thus, "C2-C6 alkynyl" means an alkynyl radical having from 2 to 6 carbon atoms. Examples of alkynyl groups include, but are not limited to, ethynyl, 2-propynyl, and 2-butynyl. The straight or branched portion of the alkynyl group may contain triple bonds as permitted by normal valency, and may be optionally mono-, di-, tri-, tetra-, or penta-substituted on any position as permitted by normal valency.

As used herein, "alkoxyl" or "alkoxy" refers to an alkyl group as defined above with the indicated number of carbon atoms attached through an oxygen bridge. For example, "(C1-C3)alkoxy" includes methoxy, ethoxy and propoxy. For example, "(C1-C6)alkoxy", is intended to include C1, C2, C3, C4, C5, and C6 alkoxy groups. For example, "(C1-C8)alkoxy", is intended to include C1, C2, C3, C4, C5, C6, C7, and C8 alkoxy groups. Examples of alkoxy include, but are not limited to, methoxy, ethoxy, n-propoxy, i-propoxy, n-butoxy, s-butoxy, t-butoxy, n-pentoxy, s-pentoxy, n-heptoxy, and n-octoxy. "Alkylthio" means an alkyl radical attached through a sulfur linking atom. The terms "alkylamino" or "aminoalkyl", means an alkyl radical attached through an NH linkage. "Dialkylamino" means two alkyl radical attached through a nitrogen linking atom. The amino groups may be unsubstituted, monosubstituted, or di-substituted. In some embodiments, the two alkyl radicals are the same (e.g., N,N-dimethylamino). In some embodiments, the two alkyl radicals are different (e.g., N-ethyl-N-methylamino).

As used herein, "aryl" or "aromatic" means any stable monocyclic or polycyclic carbon ring of up to 7 atoms in each ring, wherein at least one ring is aromatic. Examples of aryl groups include, but are not limited to, phenyl, naphthyl, anthracenyl, tetrahydronaphthyl, indanyl, and biphenyl. In cases where the aryl substituent is bicyclic and one ring is non-aromatic, it is understood that attachment is via the aromatic ring. Aryl groups are optionally mono-, di-, tri-, tetra-, or penta-substituted on any position as permitted by normal valency. The term "arylalkyl" or the term "aralkyl" refers to alkyl substituted with an aryl. The term "arylalkoxy" refers to an alkoxy substituted with aryl. "Hetero" refers to the replacement of at least one carbon atom in a ring system with at least one heteroatom selected from N, S and O. "Hetero" also refers to the replacement of at least one carbon atom in an acyclic system. A hetero ring system or a hetero acyclic system may have, for example, 1, 2 or 3 carbon atoms replaced by a heteroatom.

As used herein, the term "heteroaryl" represents a stable monocyclic or polycyclic ring of up to 7 atoms in each ring, wherein at least one ring is aromatic and contains from 1 to 4 heteroatoms selected from the group consisting of O, N and S. Examples of heteroaryl groups include, but are not limited to, acridinyl, carbazolyl, cinnolinyl, quinoxalinyl, pyrrazolyl, indolyl, benzotriazolyl, furanyl, thienyl, benzothienyl, benzofuranyl, benzimidazolonyl, benzoxazolonyl, quinolinyl, isoquinolinyl, dihydroisoindolonyl, imidazopyridinyl, isoindolonyl, indazolyl, oxazolyl, oxadiazolyl, isoxazolyl, indolyl, pyrazinyl, pyridazinyl, pyridinyl, pyrimidinyl, pyrrolyl, tetrahydroquinoline. "Heteroaryl" is also understood to include the N-oxide derivative of any nitrogen-containing heteroaryl. In cases where the heteroaryl substituent is bicyclic and one ring is non-aromatic or contains no heteroatoms, it is understood that attachment is via the aromatic ring or via the heteroatom containing ring. Heteroaryl groups are optionally mono-, di-, tri-, tetra-, or penta-substituted on any position as permitted by normal valency.

As used herein, the term "heterocycle," "heterocyclic," or "heterocyclyl" means a 3- to 14-membered aromatic or nonaromatic heterocycle containing from 1 to 4 heteroatoms selected from the group consisting of O, N and S, including polycyclic groups. As used herein, the term "heterocyclic" is also considered to be synonymous with the terms "heterocycle" and "heterocyclyl" and is understood as also having the same definitions set forth herein. "Heterocyclyl" includes the above mentioned heteroaryls, as well as dihydro and tetrahydro analogs thereof. Examples of heterocyclyl groups include, but are not limited to, azetidinyl, benzoimidazolyl, benzofuranyl, benzofurazanyl, benzopyrazolyl, benzotriazolyl, benzothiophenyl, benzoxazolyl, carbazolyl, carbolinyl, cinnolinyl, furanyl, imidazolyl, indolinyl, indolyl, indolazinyl, indazolyl, isobenzofuranyl, isoindolyl, isoquinolyl, isothiazolyl, isoxazolyl, naphthpyridinyl, oxadiazolyl, oxooxazolidinyl, oxazolyl, oxazoline, oxopiperazinyl, oxopyrrolidinyl, oxomorpholinyl, isoxazoline, oxetanyl, pyranyl, pyrazinyl, pyrazolyl, pyridazinyl, pyridopyridinyl, pyridazinyl, pyridyl, pyridinonyl, pyrimidyl, pyrimidinonyl, pyrrolyl, quinazolinyl, quinolyl, quinoxalinyl, tetrahydropyranyl, tetrahydrofuranyl, tetrahydrothiopyranyl, tetrahydroisoquinolinyl, tetrazolyl, tetrazolopyridyl, thiadiazolyl, thiazolyl, thienyl, triazolyl, 1,4-dioxanyl, hexahydroazepinyl, piperazinyl, piperidinyl, pyridin-2-onyl, pyrrolidinyl, morpholinyl, thiomorpholinyl, dihydrobenzoimidazolyl, dihydrobenzofuranyl, dihydrobenzothiophenyl, dihydrobenzoxazolyl, dihydrofuranyl, dihydroimidazolyl, dihydroindolyl, dihydroisooxazolyl, dihydroisothiazolyl, dihydrooxadiazolyl, dihydrooxazolyl, dihydropyrazinyl, dihydropyrazolyl, dihydropyridinyl, dihydropyrimidinyl, dihydropyrrolyl, dihydroquinolinyl, dihydrotetrazolyl, dihydrothiadiazolyl, dihydrothiazolyl, dihydrothienyl, dihydrotriazolyl, dihydroazetidinyl, dioxidothiomorpholinyl, methylenedioxybenzoyl, tetrahydrofuranyl, and tetrahydrothienyl, and N-oxides thereof. Attachment of a heterocyclyl substituent occurs via a carbon atom or via a heteroatom. Heterocyclyl groups are optionally mono-, di-, tri-, tetra-, or penta-substituted on any position as permitted by normal valency.

"Heterocycloalkyl" refers to a cycloalkyl residue in which one to four of the carbons is replaced by a heteroatom such as oxygen, nitrogen or sulfur. Examples of heterocycles whose radicals are heterocyclyl groups include tetrahydropyran, morpholine, pyrrolidine, piperidine, thiazolidine, oxazole, oxazoline, isoxazole, dioxane, tetrahydrofuran and the like.

The term "heteroaryl" refers to an aromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of N, O, or S if monocyclic, bicyclic, or tricyclic, respectively), wherein 0, 1, 2, 3, or 4 atoms of each ring may be substituted by a substituent. Examples of heteroaryl groups include pyridyl, furyl or furanyl, imidazolyl, benzimidazolyl, pyrimidinyl, thiophenyl or thienyl, quinolinyl, indolyl, thiazolyl, and the like. The term "heteroarylalkyl" or the term "heteroaralkyl" refers to an alkyl substituted with a heteroaryl. The term "heteroarylalkoxy" refers to an alkoxy substituted with heteroaryl.

The term "cycloalkyl" as employed herein includes saturated and partially unsaturated cyclic hydrocarbon groups having 3 to 12 carbons, for example, 3 to 8 carbons, and, for example, 3 to 6 carbons, wherein the cycloalkyl group additionally may be optionally substituted. Cycloalkyl groups include, without limitation, cyclopropyl, cyclobutyl, cyclopentyl, cyclopentenyl, cyclohexyl, cyclohexenyl, cycloheptyl, and cyclooctyl.

The term "acyl" refers to an alkylcarbonyl, cycloalkylcarbonyl, arylcarbonyl, heterocyclylcarbonyl, or heteroarylcarbonyl substituent, any of which may be further substituted by substituents.

As used herein, "keto" refers to any alkyl, alkenyl, alkynyl, cycloalkyl, cycloalkenyl, heterocyclyl, heteroaryl, or aryl group as defined herein attached through a carbonyl bridge.

Examples of keto groups include, but are not limited to, alkanoyl (e.g., acetyl, propionyl, butanoyl, pentanoyl, hexanoyl), alkenoyl (e.g., acryloyl) alkynoyl (e.g., ethynoyl, propynoyl, butynoyl, pentynoyl, hexynoyl), aryloyl (e.g., benzoyl), heteroaryloyl (e.g., pyrroloyl, imidazoloyl, quinolinoyl, pyridinoyl).

As used herein, "alkoxycarbonyl" refers to any alkoxy group as defined above attached through a carbonyl bridge (i.e., —C(O)O-alkyl). Examples of alkoxycarbonyl groups include, but are not limited to, methoxycarbonyl, ethoxycarbonyl, iso-propoxycarbonyl, n-propoxycarbonyl, t-butoxycarbonyl, benzyloxycarbonyl or n-pentoxycarbonyl.

As used herein, "aryloxycarbonyl" refers to any aryl group as defined herein attached through an oxycarbonyl bridge (i.e., —C(O)O-aryl). Examples of aryloxycarbonyl groups include, but are not limited to, phenoxycarbonyl and naphthyloxycarbonyl.

As used herein, "heteroaryloxycarbonyl" refers to any heteroaryl group as defined herein attached through an oxycarbonyl bridge (i.e., —C(O)O-heteroaryl). Examples of heteroaryloxycarbonyl groups include, but are not limited to, 2-pyridyloxycarbonyl, 2-oxazolyloxycarbonyl, 4-thiazolyloxycarbonyl, or pyrimidinyloxycarbonyl.

The term "oxo" refers to an oxygen atom, which forms a carbonyl when attached to carbon, an N-oxide when attached to nitrogen, and a sulfoxide or sulfone when attached to sulfur.

The person of ordinary skill in the art would readily understand and appreciate that the compounds and compositions disclosed herein may have certain atoms (e.g., N, O, or S atoms) in a protonated or deprotonated state, depending upon the environment in which the compound or composition is placed. Accordingly, as used herein, the structures disclosed herein envisage that certain functional groups, such as, for example, OH, SH, or NH, may be protonated or deprotonated. The disclosure herein is intended to cover the disclosed compounds and compositions regardless of their state of protonation based on the pH of the environment, as would be readily understood by the person of ordinary skill in the art.

II. RNAi Agents of the Disclosure

Described herein are RNAi agents which inhibit the expression of a MAPT gene. In one embodiment, the RNAi agent includes double stranded ribonucleic acid (dsRNA) molecules for inhibiting the expression of a MAPT gene in a cell, such as a cell within a subject, e.g., a mammal, such as a human having a MAPT-associated disease, e.g., Alzheimer's disease, FTD, PSP, or another tauopathy. The dsRNA includes an antisense strand having a region of complementarity which is complementary to at least a part of an mRNA formed in the expression of a MAPT gene. The region of complementarity is about 15-30 nucleotides or less in length. Upon contact with a cell expressing the MAPT gene, the RNAi agent inhibits the expression of the MAPT gene (e.g., a human gene, a primate gene, a non-primate gene) by at least 25%, or higher as described herein, when compared to a similar cell not contacted with the RNAi agent or an RNAi agent not complementary to the MAPT gene. Expression of the MAPT gene may be assayed by, for example, a PCR or branched DNA (bDNA)-based method, or by a protein-based method, such as by immunofluorescence analysis, using, for example, western blotting or flow cytometric techniques. In one embodiment, the level of knockdown is assayed in BE (2)-C cells using an assay method provided in Example 1 below. In some embodiments, the level of knockdown is assayed in primary mouse hepatocytes. In some embodiments, the level of knockdown is assayed in Neuro-2a cells.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence is derived from the sequence of an mRNA formed during the expression of a MAPT gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA is also contained as self-complementary regions of a single nucleic acid molecule, as opposed to being on separate oligonucleotides.

Generally, the duplex structure is 15 to 30 base pairs in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain preferred embodiments, the duplex structure is 18 to 25 base pairs in length, e.g., 18-25, 18-24, 18-23, 18-22, 18-21, 18-20, 19-25, 19-24, 19-23, 19-22, 19-21, 19-20, 20-25, 20-24, 20-23, 20-22, 20-21, 21-25, 21-24, 21-23, 21-22, 22-25, 22-24, 22-23, 23-25, 23-24 or 24-25 base pairs in length, for example, 19-21 basepairs in length. Ranges and lengths intermediate to the above recited ranges and lengths are also contemplated to be part of the disclosure.

Similarly, the region of complementarity to the target sequence is 15 to 30 nucleotides in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 nucleotides in length, for example 19-23 nucleotides in length or 21-23 nucleotides in length. Ranges and lengths intermediate to the above recited ranges and lengths are also contemplated to be part of the disclosure.

In some embodiments, the duplex structure is 19 to 30 base pairs in length. Similarly, the region of complementarity to the target sequence is 19 to 30 nucleotides in length.

In some embodiments, the dsRNA is 15 to 23 nucleotides in length, 19 to 23 nucleotides in length, or 25 to 30 nucleotides in length. In general, the dsRNA is long enough to serve as a substrate for the Dicer enzyme. For example, it is well known in the art that dsRNAs longer than about 21-23 nucleotides serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 15 to 36 base pairs, e.g., 15-36, 15-35, 15-34, 15-33, 15-32, 15-31, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 base pairs, for example, 19-21 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an RNAi agent useful to target MAPT expression is not generated in the target cell by cleavage of a larger dsRNA.

A dsRNA as described herein further include one or more single-stranded nucleotide overhangs e.g., 1, 2, 3, or 4 nucleotides. A nucleotide overhang comprises or consists of a nucleotide/nucleoside analog, including a deoxynucleotide/nucleoside. The overhang(s) are on the sense strand, the antisense strand or any combination thereof. Furthermore, the nucleotide(s) of an overhang are present on the 5-end, 3'-end or both ends of either an antisense or sense strand of a dsRNA.

A dsRNA is synthesized by standard methods known in the art. Double stranded RNAi compounds of the invention may be prepared using a two-step procedure. First, the individual strands of the double stranded RNA molecule are prepared separately. Then, the component strands are annealed. The individual strands of the siRNA compound are prepared using solution-phase or solid-phase organic synthesis or both. Organic synthesis offers the advantage that the oligonucleotide strands comprising unnatural or modified nucleotides are easily prepared. Similarly, single-stranded oligonucleotides of the invention are prepared using solution-phase or solid-phase organic synthesis or both.

In one aspect, a dsRNA of the disclosure includes at least two nucleotide sequences, a sense sequence and an antisense sequence. The sense strand sequence for MAPT may be selected from the group of sequences provided in any one of Tables 3-6, and the corresponding nucleotide sequence of the antisense strand of the sense strand may be selected from the group of sequences of any one of Tables 3-6. In this aspect, one of the two sequences is complementary to the other of the two sequences, with one of the sequences being substantially complementary to a sequence of an mRNA generated in the expression of a MAPT gene. As such, in this aspect, a dsRNA will include two oligonucleotides, where one oligonucleotide is described as the sense strand (passenger strand) in any one of Tables 3-6, and the second oligonucleotide is described as the corresponding antisense strand (guide strand) of the sense strand in any one of Tables 3-6.

In one embodiment, the sense strand comprises at least 15 contiguous nucleotides differing by no more than three nucleotides from any one of the nucleotide sequence of nucleotides 506-526, 507-527, 508-528, 509-529, 510-530, 511-531, 512-532, 513-533, 514-534, 515-535, 516-536, 517-537, 518-538, 519-539, 520-540, 521-541, 522-542, 523-543, 524-544, 525-545, 526-544, 526-546, 527-547, 528-548, 529-549, 530-550, 531-551, 532-552, 533-553, 969-989, 970-990, 971-991, 972-992, 973-993, 974-994, 975-995, 976-996, 977-997, 978-997, 978-998, 979-997, 979-999, 980-1000, 981-1001, 982-1002, 983-1003, 984-1004, 985-1003, 985-1005, 986-1006, 987-1007, 988-1008, 989-1009, 990-1010, 1069-1089, 1070-1090, 1071-1091, 1072-1092, 1073-1093, 1074-1094, 1075-1095, 1076-1096, 1077-1095, 1077-1097, 1078-1098, 1079-1099, 1080-1100, 1081-1101, 5511-5531, 5512-5532, 5513-5533, 5514-5534, 5515-5535, 5516-5536, 5517-5537, 5518-5538, 5519-5539, 5520-5540, 5521-5541, 5522-5542, and 5523-5543 of SEQ ID NO: 1, and the antisense strand comprises at least 15 contiguous nucleotides from the corresponding nucleotide sequence of SEQ ID NO: 2.

In one embodiment, the sense strand comprises at least 15 contiguous nucleotides differing by no more than three nucleotides from any one of the nucleotide sequence of nucleotides 1072-1092, 1067-1087, and 514-534 of SEQ ID NO: 3, and the antisense strand comprises at least 15 contiguous nucleotides from the corresponding nucleotide sequence of SEQ ID NO: 4.

In one embodiment, the antisense strand comprises at least 15 contiguous nucleotides differing by no more than three nucleotides from any one of the antisense strand nucleotide sequences of a duplex selected from the group consisting of AD-1397070, AD-1397072, AD-1397073, AD-1397075, AD-1397081, AD-1397083, AD-1397088, AD-1397249, AD-1397252, AD-1397253, AD-1397258, AD-1397261, AD-1397262, AD-1397263, AD-1397291, AD-1397293, AD-1397294, AD-1397295, AD-1397298, AD-1397299, AD-1637732, AD-1637733, AD-1637734, AD-1637735, AD-1637736, AD-1637737, AD-1637739, AD-1637744, AD-1637745, AD-1637746, AD-1637747, AD-1637748, AD-1637749, AD-1637750, AD-1637751, AD-1637752, AD-1637753, AD-1637754, AD-1637755, AD-1637756, AD-1637757, AD-1637758, AD-1637759, AD-1637760, AD-1637761, AD-1637762, AD-1637763, AD-1637764, AD-1637765, AD-1637766, AD-1637767, AD-1637768, AD-1637769, AD-1637770, AD-1637771, AD-1637772, AD-1637773, AD-1637774, AD-1637775, AD-1637776, AD-1637777, AD-1637778, AD-1637779, AD-1637780, AD-1637781, AD-1637782, AD-1637783, AD-1637784, AD-1637785, AD-1637786, AD-1637787, AD-1637788, AD-1637789, AD-1637790, AD-1637791, AD-1637792, AD-1637793, AD-1637794, AD-1637795, AD-1637796, AD-1637797, AD-1637798, AD-1637799, AD-1637800, AD-1637801, AD-1637802, AD-1637803, AD-1637804, AD-1637805, AD-1637806, AD-1637807, AD-1637808, AD-1637809, AD-1637810, AD-1637811, AD-1637812, AD-1637813, AD-1637814, AD-1637815, AD-1637816, AD-1637817, AD-1637818, AD-1637819, AD-1637820, AD-1637821, AD-1637822, AD-1637823, AD-1637824, AD-1637825, AD-1637826, AD-1637827, AD-1637828, AD-1637829, AD-1637830, AD-1637831, AD-1637832, AD-1637833, AD-1637834, AD-1637835, AD-1637836, AD-1637837, AD-1637838, AD-1637839, AD-1637840, AD-1637841, AD-1637842, AD-1637843, AD-1637844, AD-1637845, AD-1637846, AD-1637847, AD-1637848, AD-1637849, AD-1637850, AD-1637851, AD-1637852, AD-1637853, AD-1637854, AD-1637855, AD-1637856, AD-1637857, AD-1637858, AD-1637859, AD-1637860, AD-1637861, AD-1637862, AD-1637863, AD-1637864, AD-1637865, AD-1637866, AD-1637867, AD-1637868, AD-1637869, AD-1637870, AD-1637871, AD-1637872, AD-1637873, AD-1637874, AD-1637875, AD-1637876, AD-1637877, AD-1637878, AD-1637879, AD-1637880, AD-1637881, AD-1637882, AD-1637883, AD-1637884, AD-1637885, AD-1637886, AD-1637887, AD-1637888, AD-1637889, AD-1637890, AD-1637891, AD-1637892, AD-1637893, AD-1637894, AD-1637895, AD-1637896, AD-1637897, AD-1637898, AD-1637899, AD-1637900, AD-1637901, AD-1637902, AD-1637903, AD-1637904, AD-1637905, AD-1637906, AD-1637907, AD-1637908, AD-1637909, AD-1637910, AD-1637911, AD-1637912, AD-1637913, AD-1637914, AD-1637915, AD-1637916, AD-1637917, AD-1637918, AD-1637919, AD-1637920, AD-1637921, AD-1637922, AD-1637923, AD-1637924, AD-1637925, AD-1637926, AD-1637927, AD-1637928, AD-1637929, AD-1637930, AD-1637931, AD-1637932, AD-1637933, AD-1637934, AD-1637935, AD-1637936, AD-1637937, AD-1637938, AD-1637939, AD-1637940, AD-1637941, AD-1637942, AD-1637943, AD-1637944, AD-1637945, AD-1637946, AD-1637947, AD-1637948, AD-1637949, AD-1637950, AD-1637951, AD-1637952, AD-1637953, AD-1637954, AD-1637955, AD-1637956, AD-1637957, AD-1637958, AD-1637959, AD-1637960, AD-397167, AD-523565, AD-1623140, AD-1637701, AD-1786708, and AD-1786708v2. In certain embodiments, the duplex is selected from the group consisting of AD-1637922, AD-1637806, AD-1637762, AD-1637777, AD-1637779, AD-1397081, AD-1637793, AD-1637798, AD-1637807, AD-1637829, AD-1637831, AD-1637840, AD-1637841, AD-1637855, AD-1637883, and AD-1637884. In certain embodiments, the duplex is selected from the group consisting of AD-1623140, AD-1786708, and AD-1637701. In certain embodiments, the duplex is AD-1786708.

In one embodiment, the nucleotide sequence of the sense strand comprises at least 15 contiguous nucleotides corresponding to the MAPT gene exon 10 sense strand sequence set forth in SEQ ID NO.: 992 and an antisense strand comprising a sequence complementary thereto.

In one embodiment, the substantially complementary sequences of the dsRNA are contained on separate oligonucleotides. In another embodiment, the substantially complementary sequences of the dsRNA are contained on a single oligonucleotide.

It will be understood that, although the sequences in Tables 4 and 6, are described as modified or conjugated sequences, the RNA of the RNAi agent of the disclosure e.g., a dsRNA of the disclosure, may comprise any one of the sequences set forth in Tables 3 or 5, that is un-modified, un-conjugated, or modified or conjugated differently than described therein. For example, although the sense strands of the agents of the invention may be conjugated to a GalNAc ligand, these agents may be conjugated to a moiety that directs delivery to the CNS, e.g., a C16 ligand, as described herein. In one embodiment, the lipophilic moiety contains a saturated or unsaturated C16 hydrocarbon chain (e.g., a linear C16 alkyl or alkenyl). A lipophilic ligand included in any of the positions provided in the instant application. In some embodiments, the lipophilic moiety is conjugated to a nucleobase, sugar moiety, or internucleosidic linkage of the double-stranded iRNA agent. For example, a C16 ligand may be conjugated via the 2'-oxygen of a ribonucleotide as shown in the following structure:

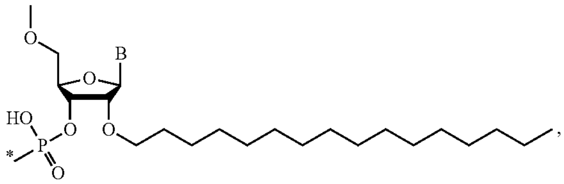
, where * denotes a bond to an adjacent nucleotide, and B is a nucleobase or a nucleobase analog, optionally where B is adenine, guanine, cytosine, thymine or uracil. Design and Synthesis of the ligands and monomers provided herein are described, for example, in PCT publication Nos. WO2019/217459, WO2020/132227, and WO2020/257194, contents of which are incorporated herein by reference in their entirety.

In some embodiments, the double-stranded iRNA agent further comprises a phosphate or phosphate mimic at the 5'-end of the antisense strand. In one embodiment, the phosphate mimic is a 5'-vinyl phosphonate (VP). In one embodiment, the phosphate mimic is a 5'-cyclopropyl phosphonate (VP). In some embodiments, the 5'-end of the antisense strand of the double-stranded iRNA agent does not contain a 5'-vinyl phosphonate (VP).

In other embodiments, each of the duplexes of Tables 4 may be particularly modified to provide another double-stranded iRNA agent of the present disclosure. In one example, the 3'-terminus of each sense duplex may be modified by removing the 3'-terminal L96 ligand and exchanging the two phosphodiester internucleotide linkages between the three 3'-terminal nucleotides with phosphorothioate internucleotide linkages. That is, the three 3'-terminal nucleotides (N) of a sense sequence of the formula:

$$5'\text{-}N_1\text{-} \ldots \text{-}N_{n-2}N_{n-1}N_nL96\ 3'$$

may be replaced with $$5'\text{-}N_1\text{-} \ldots \text{-}N_{n-2}\underline{\mathbf{s}}N_{n-1}\underline{\mathbf{s}}N_n\ 3'.$$

That is, for example, for AD-1397081, the sense sequence:

(SEQ ID NO: 434)
asusagu(Chd)uaCfAfAfaccaguugaaL96 may be replaced with (SEQ ID NO: 1005)
asusagu(Chd)uaCfAfAfaccaguugsasa while the antisense sequence remains unchanged to provide another double-stranded iRNA agent of the present disclosure.

The skilled person is well aware that dsRNAs having a duplex structure of about 20 to 23 base pairs, e.g., 21, base pairs have been hailed as particularly effective in inducing RNA interference (Elbashir et al., (2001) *EMBO J.*, 20:6877-6888). However, others have found that shorter or longer RNA duplex structures are also effective (Chu and Rana (2007) *RNA* 14:1714-1719; Kim et al. (2005) *Nat Biotech* 23:222-226). In the embodiments described above, by virtue of the nature of the oligonucleotide sequences provided herein, dsRNAs described herein include at least one strand of a length of minimally 21 nucleotides. It can be reasonably expected that shorter duplexes minus only a few nucleotides on one or both ends are similarly effective as compared to the dsRNAs described above. Hence, dsRNAs having a sequence of at least 15, 16, 17, 18, 19, 20, or more contiguous nucleotides derived from one of the sequences provided herein, and differing in their ability to inhibit the expression of a MAPT gene by at least about 25%, at least about 30%, at least about 40%, at least about 50%, at least about 60%, at least about 70%, at least about 80%, at least about 90%, or at least about 95% inhibition relative to a control level, from a dsRNA comprising the full sequence using the in vitro assay with, e.g., A549 cells and a 10 nM concentration of the RNA agent and the PCR assay as provided in the examples herein, are contemplated to be within the scope of the present disclosure. In some embodiments, inhibition from a dsRNA comprising the full sequence was measured using the in vitro assay with primary mouse hepatocytes.

In addition, the RNAs described herein identify a site(s) in a MAPT transcript that is susceptible to RISC-mediated cleavage. As such, the present disclosure further features RNAi agents that target within this site(s). As used herein, an RNAi agent is said to target within a particular site of an RNA transcript if the RNAi agent promotes cleavage of the transcript anywhere within that particular site. Such an RNAi agent will generally include at least about 15 contiguous nucleotides, preferably at least 19 nucleotides, from one of the sequences provided herein coupled to additional nucleotide sequences taken from the region contiguous to the selected sequence in a MAPT gene.

III. Modified RNAi Agents of the Disclosure

In one embodiment, the RNA of the RNAi agent of the disclosure e.g., a dsRNA, is un-modified, and does not comprise, e.g., chemical modifications or conjugations known in the art and described herein. In preferred embodiments, the RNA of an RNAi agent of the disclosure, e.g., a dsRNA, is chemically modified to enhance stability or other beneficial characteristics. In certain embodiments of the disclosure, substantially all of the nucleotides of an RNAi agent of the disclosure are modified. In other embodiments of the disclosure, all of the nucleotides of an RNAi agent of the disclosure are modified. RNAi agents of the disclosure in which "substantially all of the nucleotides are modified" are largely but not wholly modified and include not more than 5, 4, 3, 2, or unmodified nucleotides. In still other embodiments of the disclosure, RNAi agents of the disclosure include not more than 5, 4, 3, 2 or 1 modified nucleotides.

The nucleic acids featured in the disclosure are synthesized or modified by methods well established in the art, such as those described in "Current protocols in nucleic acid chemistry," Beaucage, S. L. et al. (Edrs.), John Wiley & Sons, Inc., New York, NY, USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; or backbone modifications, including modification or replacement of the phosphodiester linkages. Specific examples of RNAi agents useful in the embodiments described herein include, but are not limited to, RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone are also considered to be oligonucleosides. In some embodiments, a modified RNAi agent will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included. In some embodiments of the invention, the dsRNA agents of the invention are in a free acid form. In other embodiments of the invention, the dsRNA agents of the invention are in a salt form. In one embodiment, the dsRNA agents of the invention are in a sodium salt form. In certain embodiments, when the dsRNA agents of the invention are in the sodium salt form, sodium ions are present in the agent as counterions for substantially all of the phosphodiester and/or phosphorothiotate groups present in the agent. Agents in which substantially all of the phosphodiester and/or phosphorothioate linkages have a sodium counterion include not more than 5, 4, 3, 2, or 1 phosphodiester and/or phosphorothioate linkages without a sodium counterion. In some embodiments, when the dsRNA agents of the invention are in the sodium salt form, sodium ions are present in the agent as counterions for all of the phosphodiester and/or phosphorothiotate groups present in the agent.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the entire contents of each of which are hereby incorporated herein by reference.

In other embodiments, suitable RNA mimetics are contemplated for use in RNAi agents, in which both the sugar and the internucleoside linkage, i.e., the backbone, of the nucleotide units are replaced with alternate groups. The base units are maintained for hybridization with an appropriate nucleic acid target compound. One such oligomeric compound, a RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the RNAi agents of the disclosure are described in, for example, in Nielsen et al., Science, 1991, 254, 1497-1500.

Some embodiments featured in the disclosure include RNAs with phosphorothioate backbones and oligonucleosides with heteroatom backbones, and in particular —$CH_2$—NH—$CH_2$—, —$CH_2$—$N(CH_3)$—O—$CH_2$-[known as a methylene (methylimino) or MMI backbone], —$CH_2$—O—$N(CH_3)$—$CH_2$—, —$CH_2$—$N(CH_3)$—$N(CH_3)$—$CH_2$— and —$N(CH_3)$—$CH_2$-[wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs also contain one or more substituted sugar moieties. The RNAi agents, e.g., dsRNAs, featured herein include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl are substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)_nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an RNAi agent, or a group for improving the pharmacodynamic properties of an RNAi agent, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., Helv. Chim. Acta, 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—$N(CH_2)_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-$OCH_3$), 2'-aminopropoxy (2'-$OCH_2CH_2CH_2NH_2$), 2'-O-hexadecyl, and 2'-fluoro (2'-F). Similar modifications are also made at other positions on the RNA of an RNAi agent, particularly the 3' position of the sugar on the 3' terminal nucleotide or in 2'-5' linked dsRNAs and the 5' position of 5' terminal nucleotide. RNAi agents also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An RNAi agent of the disclosure also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., (1991) Angewandte Chemie, International Edition, 30:613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the disclosure. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

An RNAi agent of the disclosure are also modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193).

An RNAi agent of the disclosure are also modified to include one or more bicyclic sugar moieties. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the disclosure may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH2-O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the disclosure include without limitation nucleosides comprising a bridge between the 4' and the 2' ribosyl ring atoms. In certain embodiments, the antisense polynucleotide agents of the disclosure include one or more bicyclic nucleosides comprising a 4' to 2' bridge. Examples of such 4' to 2' bridged bicyclic nucleosides, include but are not limited to 4'-(CH2)-O-2' (LNA); 4'-(CH2)-S-2'; 4'-(CH2)2-O-2' (ENA); 4'-CH(CH3)-O-2' (also referred to as "constrained ethyl" or "cEt") and 4'-CH(CH2OCH3)-O-2' (and analogs thereof; see, e.g., U.S. Pat. No. 7,399,845); 4'-C(CH3)(CH3)-O-2' (and analogs thereof; see e.g., U.S. Pat. No. 8,278,283); 4'-CH2-N(OCH3)-2' (and analogs thereof; see e.g., U.S. Pat. No. 8,278,425); 4'-CH2-O—N(CH3)-2' (see, e.g., U.S. Patent Publication No. 2004/0171570); 4'-CH2-N(R)—O-2', wherein R is H, C1-C12 alkyl, or a protecting group (see, e.g., U.S. Pat. No. 7,427,672); 4'-CH2-C(H)(CH3)-2' (see, e.g., Chattopadhyaya et al., J. Org. Chem., 2009, 74, 118-134); and 4'-CH2-C(=CH2)-2' (and analogs thereof; see, e.g., U.S. Pat. No. 8,278,426). The entire contents of each of the foregoing are hereby incorporated herein by reference.

Additional representative US Patents and US Patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193;

8,030,467; 8,278,425; 8,278,426; 8,278,283; US 2008/0039618; and US 2009/0012281, the entire contents of each of which are hereby incorporated herein by reference.

Any of the foregoing bicyclic nucleosides are prepared having one or more stereochemical sugar configurations including for example α-L-ribofuranose and β-D-ribofuranose (see WO 99/14226).

An RNAi agent of the disclosure are also modified to include one or more constrained ethyl nucleotides. As used herein, a "constrained ethyl nucleotide" or "cEt" is a locked nucleic acid comprising a bicyclic sugar moiety comprising a 4'-CH(CH3)-O-2' bridge. In one embodiment, a constrained ethyl nucleotide is in the S conformation referred to herein as "S-cEt."

An RNAi agent of the disclosure may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US 2013/0190383; and WO 2013/036868, the entire contents of each of which are hereby incorporated herein by reference.

In some embodiments, an RNAi agent of the disclosure comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series,* 52, 133-134 (2008) and Fluiter et al., *Mol. Biosyst.,* 2009, 10, 1039 hereby incorporated by reference).

Representative U.S. publications that teach the preparation of UNA include, but are not limited to, U.S. Pat. No. 8,314,227; and US Patent Publication Nos. 2013/0096289; 2013/0011922; and 2011/0313020, the entire contents of each of which are hereby incorporated herein by reference.

An RNAi agent of the disclosure may also include one or more "cyclohexene nucleic acids" or ("CeNA"). CeNA are nucleotide analogs with a replacement of the furanose moiety of DNA by a cyclohexene ring. Incorporation of cylcohexenyl nucleosides in a DNA chain increases the stability of a DNA/RNA hybrid. CeNA is stable against degradation in serum and a CeNA/RNA hybrid is able to activate *E. Coli* RNase H, resulting in cleavage of the RNA strand. (see Wang et al., *Am. Chem. Soc.* 2000, 122, 36, 8595-8602, hereby incorporated by reference).

Potentially stabilizing modifications to the ends of RNA molecules include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted 2'-deoxy-modified ribonucleotide, such as inverted dT(idT), inverted dA (idA), and inverted abasic 2'-deoxyribonucleotide (iAb) others. Disclosure of this modification can be found in WO 2011/005861.

In one example, the 3' or 5' terminal end of a oligonucleotide is linked to an inverted 2'-deoxy-modified ribonucleotide, such as inverted dT(idT), inverted dA (idA), or a inverted abasic 2'-deoxyribonucleotide (iAb). In one particular example, the inverted 2'-deoxy-modified ribonucleotide is linked to the 3' end of an oligonucleotide, such as the 3'-end of a sense strand described herein, where the linking is via a 3'-3' phosphodiester linkage or a 3'-3'-phosphorothioate linkage.

In another example, the 3'-end of a sense strand is linked via a 3'-3'-phosphorothioate linkage to an inverted abasic ribonucleotide (iAb). In another example, the 3'-end of a sense strand is linked via a 3'-3'-phosphorothioate linkage to an inverted dA (idA).

In one particular example, the inverted 2'-deoxy-modified ribonucleotide is linked to the 3' end of an oligonucleotide, such as the 3'-end of a sense strand described herein, where the linking is via a 3'-3' phosphodiester linkage or a 3'-3'-phosphorothioate linkage.

In another example, the 3'-terminal nucleotides of a sense strand is an inverted dA (idA) and is linked to the preceding nucleotide via a 3'-3'-linkage (e.g., 3'-3'-phosphorothioate linkage).

Other modifications of an RNAi agent of the disclosure include a 5' phosphate or 5' phosphate mimic, e.g., a 5'-terminal phosphate or phosphate mimic on the antisense strand of an RNAi agent. Suitable phosphate mimics are disclosed in, for example US 2012/0157511, the entire contents of which are incorporated herein by reference.

A. Modified Rnai Agents Comprising Motifs of the Disclosure

In certain aspects of the disclosure, the double-stranded RNAi agents of the disclosure include agents with chemical modifications as disclosed, for example, in WO 2013/075035, the entire contents of which are incorporated herein by reference. As shown herein and in WO 2013/075035, a superior result may be obtained by introducing one or more motifs of three identical modifications on three consecutive nucleotides into a sense strand or antisense strand of an RNAi agent, particularly at or near the cleavage site. In some embodiments, the sense strand and antisense strand of the RNAi agent may otherwise be completely modified. The introduction of these motifs interrupts the modification pattern, if present, of the sense or antisense strand. The RNAi agent may be optionally conjugated with a lipophilic ligand, e.g., a C16 ligand, for instance on the sense strand. The RNAi agent may be optionally modified with a (S)-glycol nucleic acid (GNA) modification, for instance on one or more residues of the antisense strand. The resulting RNAi agents present superior gene silencing activity.

Accordingly, the disclosure provides double stranded RNAi agents capable of inhibiting the expression of a target gene (i.e., a MAPT gene) in vivo. The RNAi agent comprises a sense strand and an antisense strand. Each strand of the RNAi agent may be 15-30 nucleotides in length. For example, each strand may be 16-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length. In certain embodiments, each strand is 19-23 nucleotides in length.

The sense strand and antisense strand typically form a duplex double stranded RNA ("dsRNA"), also referred to herein as an "RNAi agent." The duplex region of an RNAi agent may be 15-30 nucleotide pairs in length. For example, the duplex region is 16-30 nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27 nucleotides in length. In preferred embodiments, the duplex region is 19-21 nucleotide pairs in length.

In one embodiment, the RNAi agent may contain one or more overhang regions or capping groups at the 3'-end, 5'-end, or both ends of one or both strands. The overhang is 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. In preferred embodiments, the nucleotide overhang region is 2 nucleotides in length. The overhangs are the result of one strand being longer than the other, or the result of two strands of the same length being staggered. The overhang forms a mismatch with the target mRNA or it is complementary to the gene sequences being targeted or is another sequence. The first and second strands can also be joined, e.g., by additional bases to form a hairpin, or by other non-base linkers.

In one embodiment, the nucleotides in the overhang region of the RNAi agent can each independently be a modified or unmodified nucleotide including, but no limited to 2'-sugar modified, such as, 2-F, 2'-O-methyl, thymidine (T), and any combinations thereof.

For example, TT is an overhang sequence for either end on either strand. The overhang forms a mismatch with the target mRNA or it is complementary to the gene sequences being targeted or is another sequence.

The 5'- or 3'-overhangs at the sense strand, antisense strand or both strands of the RNAi agent may be phosphorylated. In some embodiments, the overhang region(s) contains two nucleotides having a phosphorothioate between the two nucleotides, where the two nucleotides are the same or different. In one embodiment, the overhang is present at the 3'-end of the sense strand, antisense strand, or both strands. In one embodiment, this 3'-overhang is present in the antisense strand. In one embodiment, this 3'-overhang is present in the sense strand.

The RNAi agent may contain only a single overhang, which can strengthen the interference activity of the RNAi, without affecting its overall stability. For example, the single-stranded overhang may be located at the 3-terminal end of the sense strand or, alternatively, at the 3-terminal end of the antisense strand. The RNAi may also have a blunt end, located at the 5'-end of the antisense strand (or the 3'-end of the sense strand) or vice versa. Generally, the antisense strand of the RNAi has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In one embodiment, the RNAi agent is double blunt-ended and 19 nucleotides in length, wherein the sense strand contains at least one motif of three 2'-F modifications on three consecutive nucleotides at positions 7, 8, 9 from the 5'-end. The antisense strand contains at least one motif of three 2'-O-methyl modifications on three consecutive nucleotides at positions 11, 12, 13 from the 5'-end.

In another embodiment, the RNAi agent is double blunt-ended and 20 nucleotides in length, wherein the sense strand contains at least one motif of three 2'-F modifications on three consecutive nucleotides at positions 8, 9, 10 from the 5'-end. The antisense strand contains at least one motif of three 2'-O-methyl modifications on three consecutive nucleotides at positions 11, 12, 13 from the 5'-end.

In yet another embodiment, the RNAi agent is a double blunt-ended and 21 nucleotides in length, wherein the sense strand contains at least one motif of three 2'-F modifications on three consecutive nucleotides at positions 9, 10, 11 from the 5'-end. The antisense strand contains at least one motif of three 2'-O-methyl modifications on three consecutive nucleotides at positions 11, 12, 13 from the 5'-end.

In one embodiment, the RNAi agent comprises a 21 nucleotide sense strand and a 23 nucleotide antisense strand, wherein the sense strand contains at least one motif of three 2'-F modifications on three consecutive nucleotides at positions 9, 10, 11 from the 5'-end; the antisense strand contains at least one motif of three 2'-O-methyl modifications on three consecutive nucleotides at positions 11, 12, 13 from the 5'-end, wherein one end of the RNAi agent is blunt, while the other end comprises a 2 nucleotide overhang. Preferably, the 2 nucleotide overhang is at the 3'-end of the antisense strand. When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In one embodiment, every nucleotide in the sense strand and the antisense strand of the RNAi agent, including the nucleotides that are part of the motifs are modified nucleotides. In one embodiment each residue is independently modified with a 2'-O-methyl or 3'-fluoro, e.g., in an alternating motif. Optionally, the RNAi agent further comprises a ligand (e.g., a lipophilic ligand, optionally a C16 ligand).

In one embodiment, the RNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In one embodiment, the RNAi agent comprises sense and antisense strands, wherein the RNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1-4 nucleotides longer at its 3' end than the first strand, wherein the duplex region which is at least 25 nucleotides in length, and the second strand is sufficiently complementary to a target mRNA along at least 19 nucleotide of the second strand length to reduce target gene expression when the RNAi agent is introduced into a mammalian cell, and wherein dicer cleavage of the RNAi agent preferentially results in an siRNA comprising the 3' end of the second strand, thereby reducing expression of the target gene in the mammal. Optionally, the RNAi agent further comprises a ligand.

In one embodiment, the sense strand of the RNAi agent contains at least one motif of three identical modifications on three consecutive nucleotides, where one of the motifs occurs at the cleavage site in the sense strand.

In one embodiment, the antisense strand of the RNAi agent also contains at least one motif of three identical modifications on three consecutive nucleotides, where one of the motifs occurs at or near the cleavage site in the antisense strand.

For an RNAi agent having a duplex region of 17-23 nucleotide in length, the cleavage site of the antisense strand is typically around the 10, 11 and 12 positions from the 5'-end. Thus the motifs of three identical modifications may occur at the 9, 10, 11 positions; 10, 11, 12 positions; 11, 12, 13 positions; 12, 13, 14 positions; or 13, 14, 15 positions of the antisense strand, the count starting from the 1' nucleotide from the 5'-end of the antisense strand, or, the count starting from the 1' paired nucleotide within the duplex region from the 5'-end of the antisense strand. The cleavage site in the antisense strand may also change according to the length of the duplex region of the RNAi from the 5'-end.

The sense strand of the RNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand are so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In one embodiment, the sense strand of the RNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other, then the chemistry of the motifs are distinct from each other and when the motifs are separated by one or more nucleotide than the chemistries are the same or different. Two or more wing modifications may be present. For instance, when two wing modifications are present, each wing modification may occur at one end relative to the first motif which is at or near cleavage site or on either side of the lead motif.

Like the sense strand, the antisense strand of the RNAi agent may contain more than one motif of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In one embodiment, the wing modification on the sense strand or antisense strand of the RNAi agent typically does not include the first one or two terminal nucleotides at the 3'-end, 5'-end or both ends of the strand.

In another embodiment, the wing modification on the sense strand or antisense strand of the RNAi agent typically does not include the first one or two paired nucleotides within the duplex region at the 3'-end, 5'-end or both ends of the strand.

When the sense strand and the antisense strand of the RNAi agent each contain at least one wing modification, the wing modifications may fall on the same end of the duplex region, and have an overlap of one, two or three nucleotides.

When the sense strand and the antisense strand of the RNAi agent each contain at least two wing modifications, the sense strand and the antisense strand are so aligned that two modifications each from one strand fall on one end of the duplex region, having an overlap of one, two or three nucleotides; two modifications each from one strand fall on the other end of the duplex region, having an overlap of one, two or three nucleotides; two modifications one strand fall on each side of the lead motif, having an overlap of one, two, or three nucleotides in the duplex region.

In one embodiment, the RNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In one embodiment, the RNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In one embodiment, the nucleotide at the 1 position within the duplex region from the 5'-end in the antisense strand is selected from the group consisting of A, dA, dU, U, and dT.

Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

In another embodiment, the nucleotide at the 3'-end of the sense strand is deoxy-thymine (dT). In another embodiment, the nucleotide at the 3'-end of the antisense strand is deoxy-thymine (dT). In one embodiment, there is a short sequence of deoxy-thymine nucleotides, for example, two dT nucleotides on the 3'-end of the sense or antisense strand.

In one embodiment, the sense strand sequence may be represented by formula (I):

$$5'\ n_p\text{-}N_a\text{-}(X\ X\ X)_i\text{-}N_b\text{-}Y\ Y\ Y\text{-}N_b\text{-}(Z\ Z\ Z)_j\text{-}N_a\text{-}n_q\ 3' \quad (I)$$

wherein:

i and j are each independently 0 or 1;

p and q are each independently 0-6;

each $N_a$ independently represents an oligonucleotide sequence comprising 0-25 modified nucleotides, each sequence comprising at least two differently modified nucleotides;

each $N_b$ independently represents an oligonucleotide sequence comprising 0-10 modified nucleotides;

each $n_p$ and $n_q$ independently represent an overhang nucleotide;

wherein Nb and Y do not have the same modification; and

XXX, YYY and ZZZ each independently represent one motif of three identical modifications on three consecutive nucleotides. Preferably YYY is all 2'-F modified nucleotides.

In one embodiment, the $N_a$ or $N_b$ comprise modifications of alternating pattern.

In one embodiment, the YYY motif occurs at or near the cleavage site of the sense strand. For example, when the RNAi agent has a duplex region of 17-23 nucleotides in length, the YYY motif occurs at or the vicinity of the cleavage site (e.g.: can occur at positions 6, 7, 8, 7, 8, 9, 8, 9, 10, 9, 10, 11, 10, 11, 12 or 11, 12, 13) of the sense strand, the count starting from the 1st nucleotide, from the 5'-end; or optionally, the count starting at the 1st paired nucleotide within the duplex region, from the 5'-end.

In one embodiment, i is 1 and j is 0, or i is 0 and j is 1, or both i and j are 1. The sense strand can therefore be represented by the following formulas:

$$5'\ n_{q'}\text{-}N_a'\text{-}(Z'Z'Z')_k\text{-}N_b'\text{-}Y'Y'Y'\text{-}N_b'\text{-}(X'X'X')_l\text{-}N'_a\text{-}n_p'\ 3' \quad (Ie)$$

When the sense strand is represented by formula (Ib), $N_b$ represents an oligonucleotide sequence comprising 0-10, 0-7, 0-5, 0-4, 0-2 or 0 modified nucleotides.

Each $N_a$ independently represents an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2 or 0 modified nucleotides. Each $N_a$ independently represents an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2 or 0 modified nucleotides. Preferably, $N_b$ is 0, 1, 2, 3, 4, 5 or 6. Each $N_a$ independently represents an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

$$5'\ n_p\text{-}N_a\text{—}YYY\text{—}N_a\text{-}n_q\ 3' \quad (Ia).$$

When the sense strand is represented by formula (Ia), each $N_a$ independently represents an oligonucleotide sequence comprising 2-20, 2-15, or 2-10 modified nucleotides.

In one embodiment, the antisense strand sequence of the RNAi may be represented by formula (II):

$$5'\ n_{q'}\text{—}N_{a'}\text{—}(Z'Z'Z')_k\text{—}N_b'\text{—}Y'Y'Y'\text{—}N_b'\text{—}(X'X'X')_l\text{—}N'_a\text{—}n_{p'}\ 3' \quad (Ie)$$

wherein:

k and l are each independently 0 or 1;

p' and q' are each independently 0-6;

each $N_a'$ independently represents an oligonucleotide sequence comprising 0-25 modified nucleotides, each sequence comprising at least two differently modified nucleotides;

each $N_b'$ independently represents an oligonucleotide sequence comprising 0-10 modified nucleotides;

each $n_p'$ and $n_q'$ independently represent an overhang nucleotide;

wherein $N_b'$ and Y' do not have the same modification;

and X'X'X', Y'Y'Y' and Z'Z'Z' each independently represent one motif of three identical modifications on three consecutive nucleotides.

In one embodiment, the $N_a'$ or $N_b'$ comprise modifications of alternating pattern.

The Y'Y'Y' motif occurs at or near the cleavage site of the antisense strand. For example, when the RNAi agent has a duplex region of 17-23 nucleotide in length, the Y'Y'Y' motif occurs at positions 9, 10, 11; 10, 11, 12; 11, 12, 13; 12, 13, 14; or 13, 14, 15 of the antisense strand, with the count starting from the 1st nucleotide, from the 5'-end; or optionally, the count starting at the 1st paired nucleotide within the duplex region, from the 5'-end. Preferably, the Y'Y'Y' motif occurs at positions 11, 12, 13.

In one embodiment, Y'Y'Y' motif is all 2'-OMe modified nucleotides.

In one embodiment, k is 1 and l is 0, or k is 0 and l is 1, or both k and l are 1.

The antisense strand are therefore be represented by the following formulas:

$$5'\ n_{q'}\text{—}N_a'\text{—}Z'Z'Z'\text{—}N_b'\text{—}Y'Y'Y'\text{—}N_a'\text{—}n_{q'}\ 3'; \quad (If)$$

$$5'\ n_{q'}\text{—}N_a'\text{—}Y'Y'Y'\text{—}N_b'\text{—}X'X'X'\text{—}n_{q'}\ 3';\ \text{or} \quad (Ig)$$

$$5'\ n_{q'}\text{—}N_a'\text{—}Z'Z'Z'\text{—}N_b'\text{—}Y'Y'Y'\text{—}N_b'\text{—}X'X'X'\text{—}N_a'\text{—}n_{q'}\ 3'. \quad (Ih)$$

When the antisense strand is represented by formula (If), $N_b$ represents an oligonucleotide sequence comprising 0-10, 0-7, 0-10, 0-7, 0-5, 0-4, 0-2 or 0 modified nucleotides. Each $N_a$' independently represents an oligonucleotide sequence comprising 2-20, 2-15, or 2-10 modified nucleotides.

When the antisense strand is represented as formula (Ig), $N_b$' represents an oligonucleotide sequence comprising 0-10, 0-7, 0-10, 0-7, 0-5, 0-4, 0-2 or 0 modified nucleotides. Each $N_a$' independently represents an oligonucleotide sequence comprising 2-20, 2-15, or 2-10 modified nucleotides.

When the antisense strand is represented as formula (Ih), each $N_b$' independently represents an oligonucleotide sequence comprising 0-10, 0-7, 0-10, 0-7, 0-5, 0-4, 0-2 or 0 modified nucleotides. Each $N_a$' independently represents an oligonucleotide sequence comprising 2-20, 2-15, or 2-10 modified nucleotides. Preferably, $N_b$ is 0, 1, 2, 3, 4, 5 or 6.

In other embodiments, k is 0 and l is 0 and the antisense strand may be represented by the formula:

$$5'\ n_{p'}\text{—}N_{a'}\text{—}Y'Y'Y'\text{—}N_{a'}\text{—}n_{q'}\ 3'. \quad \text{(Ia)}$$

When the antisense strand is represented as formula (Ie), each $N_a$' independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In one embodiment, the sense strand of the RNAi agent may contain YYY motif occurring at 9, 10 and 11 positions of the strand when the duplex region is 21 nt, the count starting from the $1^{st}$ nucleotide from the 5'-end, or optionally, the count starting at the $1^{st}$ paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In one embodiment the antisense strand may contain Y'Y'Y' motif occurring at positions 11, 12, 13 of the strand, the count starting from the $1^{st}$ nucleotide from the 5'-end, or optionally, the count starting at the $1^{st}$ paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with an antisense strand being represented by any one of formulas (Ie), (If), (Ig), and (Ih), respectively.

Accordingly, the RNAi agents for use in the methods of the disclosure may comprise a sense strand and an antisense strand, each strand having 14 to 30 nucleotides, the RNAi duplex represented by formula (Ii):

(Ii)

sense:

$$5'\ n_p\text{—}N_a\text{—}(XXX)_i\text{—}N_b\text{—}YYY\text{—}N_b\text{—}(ZZZ)_j\text{—}N_a\text{—}n_q\ 3'$$

antisense:

$$3'\ n_p'\text{—}N_a'\text{—}(X'X'X')_k\text{—}N_b'\text{—}Y'Y'Y'\text{—}N_b'\text{—}(Z'Z'Z')_l\text{—}N_a'\text{—}n_p'\ 5'$$

wherein:

i, j, k, and 1 are each independently 0 or 1;

p, p', q, and q' are each independently 0-6;

each $N_a$ and $N_a$ independently represents an oligonucleotide sequence comprising 0-25 modified nucleotides, each sequence comprising at least two differently modified nucleotides;

each $N_b$ and $N_b$ independently represents an oligonucleotide sequence comprising 0-10 modified nucleotides;

wherein each $n_p$', $n_p$, $n_q$', and $n_q$, each of which may or may not be present, independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming an RNAi duplex include the formulas below:

(Ij)

$$5'\ n_p\text{—}N_a\text{—}YYY\text{—}N_a\text{—}n_q\ 3'$$
$$3'\ n_p'\text{—}N_a'\text{—}Y'Y'Y'\text{—}N_a'\text{—}n_q'\ 5'$$

(Ik)

$$5'\ n_p\text{—}N_a\text{—}YYY\text{—}N_b\text{—}ZZZ\text{—}N_a\text{—}n_q\ 3'$$
$$3'\ n_p'\text{—}N_a'\text{—}Y'Y'Y'\text{—}N_b'\text{—}Z'Z'Z'\text{—}N_a'\text{—}n_q'\ 5'$$

(Il)

$$5'\ n_p\text{—}N_a\text{—}XXX\text{—}N_b\text{—}YYY\text{—}N_a\text{—}n_q\ 3'$$
$$3'\ n_p'\text{—}N_a'\text{—}X'X'X'\text{—}N_b'\text{—}Y'Y'Y'\text{—}N_a'\text{—}n_q'\ 5'$$

(Im)

$$5'\ n_p\text{—}N_a\text{—}XXX\text{—}N_b\text{—}YYY\text{—}N_b\text{—}ZZZ\text{—}N_a\text{—}n_q\ 3'$$
$$3'\ n_p'\text{—}N_a'\text{—}X'X'X'\text{—}N_b'\text{—}Y'Y'Y'\text{—}N_b'\text{—}Z'Z'Z'\text{—}N_a'\text{—}n_q'\ 5'$$

When the RNAi agent is represented by formula (Ij), each $N_a$ independently represents an oligonucleotide sequence comprising 2-20, 2-15, or 2-10 modified nucleotides.

When the RNAi agent is represented by formula (Ik), each $N_b$ independently represents an oligonucleotide sequence comprising 1-10, 1-7, 1-5 or 1-4 modified nucleotides. Each $N_a$ independently represents an oligonucleotide sequence comprising 2-20, 2-15, or 2-10 modified nucleotides.

When the RNAi agent is represented as formula (Il), each $N_b$, $N_b$' independently represents an oligonucleotide sequence comprising 0-10, 0-7, 0-10, 0-7, 0-5, 0-4, 0-2 or 0 modified nucleotides. Each $N_a$ independently represents an oligonucleotide sequence comprising 2-20, 2-15, or 2-10 modified nucleotides.

When the RNAi agent is represented as formula (Im), each $N_b$, $N_b$' independently represents an oligonucleotide sequence comprising 0-10, 0-7, 0-10, 0-7, 0-5, 0-4, 0-2 or 0 modified nucleotides. Each $N_a$, $N_a$' independently represents an oligonucleotide sequence comprising 2-20, 2-15, or 2-10 modified nucleotides. Each of $N_a$, $N_a$', $N_b$ and $N_b$' independently comprises modifications of alternating pattern.

In one embodiment, when the RNAi agent is represented by formula (Im), the $N_a$ modifications are 2'-O-methyl or 2'-fluoro modifications. In another embodiment, when the RNAi agent is represented by formula (Im), the $N_a$ modifications are 2'-O-methyl or 2'-fluoro modifications and $n_p$' >0 and at least one $n_p$' is linked to a neighboring nucleotide a via phosphorothioate linkage. In yet another embodiment, when the RNAi agent is represented by formula (Im), the $N_a$ modifications are 2'-O-methyl or 2'-fluoro modifications, $n_p$'>0 and at least one $n_p$' is linked to a neighboring nucleotide via phosphorothioate linkage, and the sense strand is conjugated to one or more C16 (or related) moieties attached through a bivalent or trivalent branched linker (described below). In another embodiment, when the RNAi agent is represented by formula (Im), the $N_a$ modifications are 2'-O-methyl or 2'-fluoro modifications, $n_p$'>0 and at least one $n_p$' is linked to a neighboring nucleotide via phosphorothioate linkage, the sense strand comprises at least one phosphorothioate linkage, and the sense strand is conjugated to one or more lipophilic, e.g., C16 (or related) moieties, optionally attached through a bivalent or trivalent branched linker.

In one embodiment, when the RNAi agent is represented by formula (Ij), the $N_a$ modifications are 2'-O-methyl or 2'-fluoro modifications, $n_p$'>0 and at least one $n_p$' is linked to a neighboring nucleotide via phosphorothioate linkage, the sense strand comprises at least one phosphorothioate linkage, and the sense strand is conjugated to one or more lipophilic, e.g., C16 (or related) moieties attached through a bivalent or trivalent branched linker.

In one embodiment, the RNAi agent is a multimer containing at least two duplexes represented by formula (Ii), (Ij), (Ik), (Il), and (Im), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, the RNAi agent is a multimer containing three, four, five, six or more duplexes represented by formula (Ii), (Ij), (Ik), (Il), and (Im), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two RNAi agents represented by formula (Ii), (Ij), (Ik), (Il), and (Im) are linked to each other at the 5' end, and one or both of the 3' ends and are optionally conjugated to a ligand. Each of the agents can target the same gene or two different genes; or each of the agents can target same gene at two different target sites.

Various publications describe multimeric RNAi agents that can be used in the methods of the disclosure. Such publications include WO2007/091269, WO2010/141511, WO2007/117686, WO2009/014887, and WO2011/031520; and U.S. Pat. No. 7,858,769, the entire contents of each of which are hereby incorporated herein by reference.

In certain embodiments, the compositions and methods of the disclosure include a vinyl phosphonate (VP) modification of an RNAi agent as described herein. In exemplary embodiments, a vinyl phosphonate of the disclosure has the following structure:

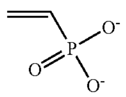

A vinyl phosphonate of the instant disclosure may be attached to either the antisense or the sense strand of a dsRNA of the disclosure. In certain embodiments, a vinyl phosphonate of the instant disclosure is attached to the antisense strand of a dsRNA, optionally at the 5' end of the antisense strand of the dsRNA.

The dsRNA agent can comprise a phosphorus-containing group at the 5'-end of the sense strand or antisense strand. The 5'-end phosphorus-containing group can be 5'-end phosphate (5'-P), 5'-end phosphorothioate (5'-PS), 5'-end phosphorodithioate (5'-PS2), 5'-end vinylphosphonate (5'-VP), 5'-end methylphosphonate (MePhos), or 5'-deoxy-5'-C-malonyl. When the 5'-end phosphorus-containing group is 5'-end vinylphosphonate (5'-VP), the 5'-VP can be either 5'-E-VP isomer (i.e., trans-vinylphosphonate,

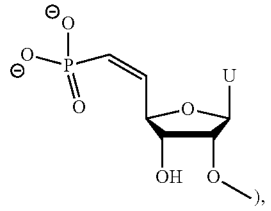

5'-Z—VP isomer (i.e., cis-vinylphosphonate,

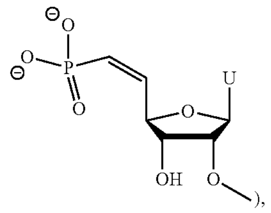

or mixtures thereof.

For example, when the phosphate mimic is a 5'-vinyl phosphonate (VP), the 5'-terminal nucleotide can have the following structure,

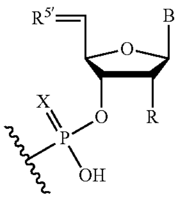

wherein X is O or S;

R is hydrogen, hydroxy, fluoro, or $C_{1-20}$alkoxy (e.g., methoxy or n-hexadecyloxy);

$R^{5'}$ is =C(H)—P(O)$(OH)_2$ and the double bond between the C5' carbon and R5' is in the E or Z orientation (e.g., E orientation); and B is a nucleobase or a modified nucleobase, optionally where B is adenine, guanine, cytosine, thymine, or uracil.

In one embodiment, $R^{5'}$ is $=C(H)-P(O)(OH)_2$ and the double bond between the C5' carbon and R5' is in the E orientation. In another embodiment, R is methoxy and $R^{5'}$ is $=C(H)-P(O)(OH)_2$ and the double bond between the C5' carbon and R5' is in the E orientation. In another embodiment, X is S, R is methoxy, and $R^{5'}$ is $=C(H)-P(O)(OH)_2$ and the double bond between the C5' carbon and R5' is in the E orientation.

Vinyl phosphate modifications are also contemplated for the compositions and methods of the instant disclosure. An exemplary vinyl phosphate structure is:

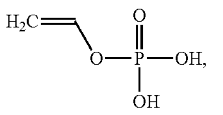

which may be substituted in the preceding phosphonate structure.

i. Thermally Destabilizing Modifications

In certain embodiments, a dsRNA molecule can be optimized for RNA interference by incorporating thermally destabilizing modifications in the seed region of the antisense strand (i.e., at positions 2-9 of the 5'-end of the antisense strand) to reduce or inhibit off-target gene silencing. It has been discovered that dsRNAs with an antisense strand comprising at least one thermally destabilizing modification of the duplex within the first 9 nucleotide positions, counting from the 5' end, of the antisense strand have reduced off-target gene silencing activity. Accordingly, in some embodiments, the antisense strand comprises at least one (e.g., one, two, three, four, five or more) thermally destabilizing modification of the duplex within the first 9 nucleotide positions of the 5' region of the antisense strand. In some embodiments, one or more thermally destabilizing modification(s) of the duplex is/are located in positions 2-9, or preferably positions 4-8, from the 5'-end of the antisense strand. In some further embodiments, the thermally destabilizing modification(s) of the duplex is/are located at position 6, 7 or 8 from the 5'-end of the antisense strand. In still some further embodiments, the thermally destabilizing modification of the duplex is located at position 7 from the 5'-end of the antisense strand. The term "thermally destabilizing modification(s)" includes modification(s) that would result with a dsRNA with a lower overall melting temperature (Tm) (preferably a Tm with one, two, three or four degrees lower than the Tm of the dsRNA without having such modification(s). In some embodiments, the thermally destabilizing modification of the duplex is located at position 2, 3, 4, 5 or 9 from the 5'-end of the antisense strand.

The thermally destabilizing modifications can include, but are not limited to, abasic modification; mismatch with the opposing nucleotide in the opposing strand; and sugar modification such as 2'-deoxy modification or acyclic nucleotide, e.g., unlocked nucleic acids (UNA), glycol nucleic acid (GNA); and 2'-5'-linked ribonucleotides ("3'-RNA").

Exemplified abasic modifications include, but are not limited to the following:

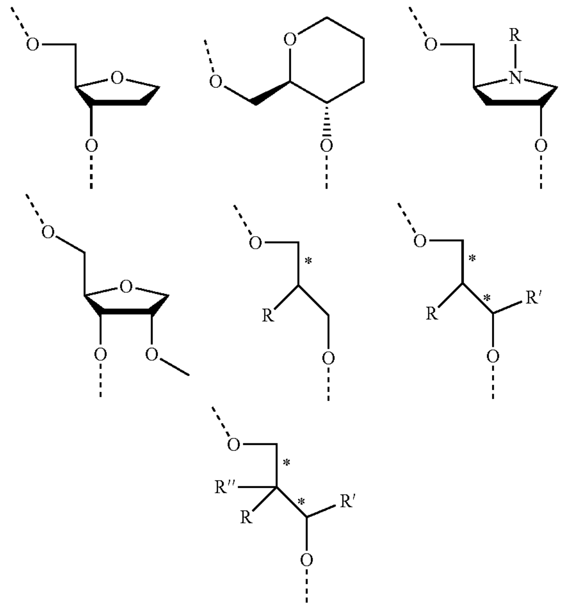

Wherein R=H, Me, Et or OMe; R'=H, Me, Et or OMe; R"=H, Me, Et or OMe

Further exemplified thermally destabilizing modifications can include, but are not limited to,

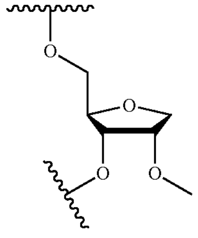

Mod2
(2'-OMe Abasic Spacer)

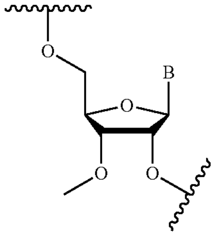

Mod3
(3'-OMe)

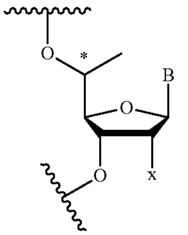

Mod4
(5'-Me)
X = OMe, F

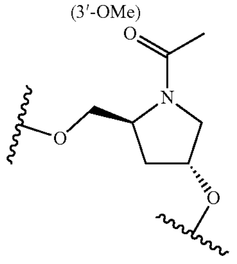

Mod5
(Hyp-spacer)

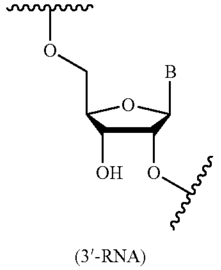

(3'-RNA)

wherein B is a modified or unmodified nucleobase.

Exemplified sugar modifications include, but are not limited to the following:

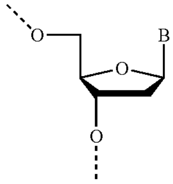

2′-deoxy

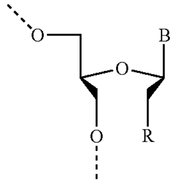

unlocked nucleic acid
R = H, OH, O-alkyl

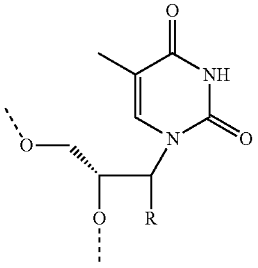

glycol nucleic acid
R = H, OH, O-alkyl

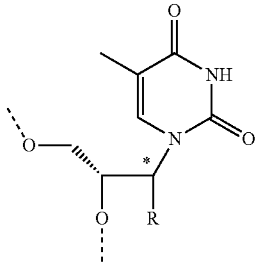

glycol nucleic acid
R = H, OH, O-alkyl

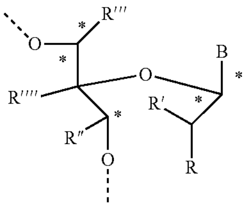

unlocked nucleic acid
R = H, OH, $CH_3$, $CH_2CH_3$, O-alkyl, $NH_2$, NHMe, $NMe_2$
R′ = H, OH, $CH_3$, $CH_2CH_3$, O-alkyl, $NH_2$, NHMe, $NMe_2$
R″ = H, OH, $CH_3$, $CH_2CH_3$, O-alkyl, $NH_2$, NHMe, $NMe_2$
R‴ = H, OH, $CH_3$, $CH_2CH_3$, O-alkyl, $NH_2$, NHMe, $NMe_2$
R⁗ = H, OH, $CH_3$, $CH_2CH_3$, O-alkyl, $NH_2$, NHMe, $NMe_2$

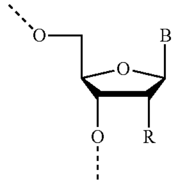

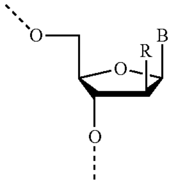

R = H, methyl, ethyl wherein B is a modified or unmodified nucleobase.

In some embodiments the thermally destabilizing modification of the duplex is selected from the group consisting of:

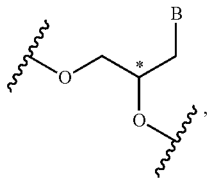

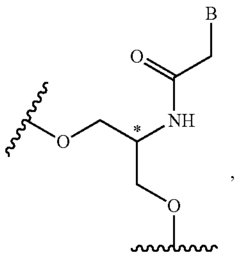

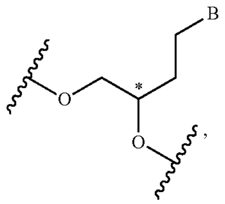

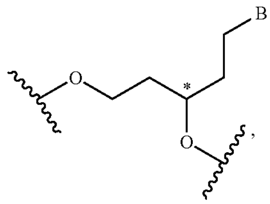

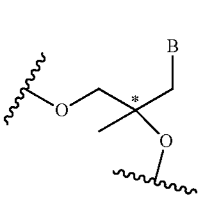

, and

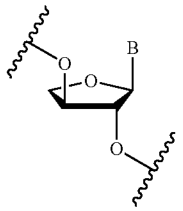

and

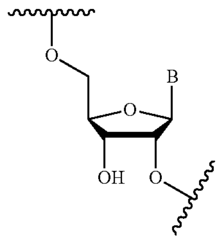

(3′-RNA)

wherein B is a modified or unmodified nucleobase and the asterisk on each structure represents either R, S or racemic.

In some embodiments the thermally destabilizing modification of the duplex is selected from the group consisting of:

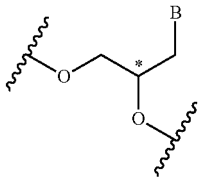

and

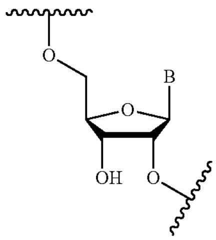

wherein B is a modified or unmodified nucleobase and the asterisk represents either R, S or racemic (e.g. S).

The term "acyclic nucleotide" refers to any nucleotide having an acyclic ribose sugar, for example, where any of bonds between the ribose carbons (e.g., C1'-C2', C2'-C3', C3'-C4', C4'-O4', or C1'-O4') is absent or at least one of ribose carbons or oxygen (e.g., C1', C2', C3', C4' or O4') are independently or in combination absent from the nucleotide. In some embodiments, acyclic nucleotide is

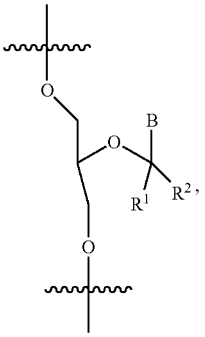
,
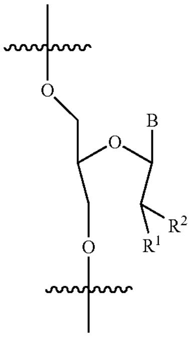
,
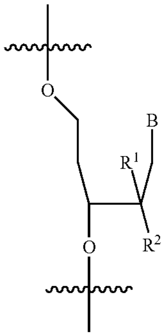
,
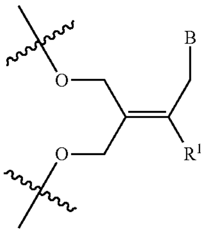
or
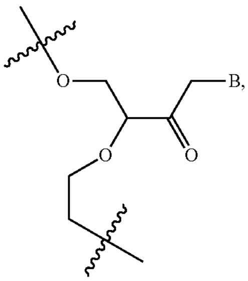
, wherein B is a modified or unmodified nucleobase, $R^1$ and $R^2$ independently are H, halogen, $OR_3$, or alkyl; and $R_3$ is H, alkyl, cycloalkyl, aryl, aralkyl, heteroaryl or sugar). The acyclic derivative provides greater backbone flexibility without affecting the Watson-Crick pairings. The acyclic nucleotide can be linked via 2'-5' or 3'-5' linkage.

The term ‘GNA’ refers to glycol nucleic acid which is a polymer similar to DNA or RNA but differing in the composition of its “backbone” in that is composed of repeating glycerol units linked by phosphodiester bonds:

(R)-GNA

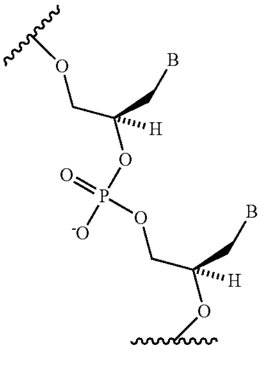
.

The thermally destabilizing modification of the duplex can be mismatches (i.e., noncomplementary base pairs) between the thermally destabilizing nucleotide and the opposing nucleotide in the opposite strand within the dsRNA duplex. Exemplary mismatch base pairs include G:G, G:A, G:U, G:T, A:A, A:C, C:C, C:U, C:T, U:U, T:T, U:T, or a combination thereof. Other mismatch base pairings known in the art are also amenable to the present invention. A mismatch can occur between nucleotides that are either naturally occurring nucleotides or modified nucleotides, i.e., the mismatch base pairing can occur between the nucleobases from respective nucleotides independent of the modifications on the ribose sugars of the nucleotides. In certain embodiments, the dsRNA molecule contains at least one nucleobase in the mismatch pairing that is a 2'-deoxy nucleobase; e.g., the 2'-deoxy nucleobase is in the sense strand.

In some embodiments, the thermally destabilizing modification of the duplex in the seed region of the antisense strand includes nucleotides with impaired W—C H-bonding to complementary base on the target mRNA, such as:

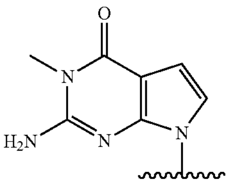
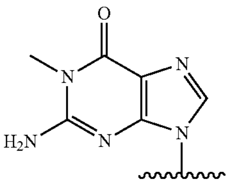
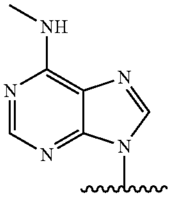
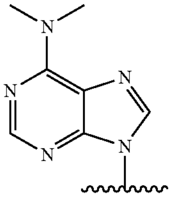
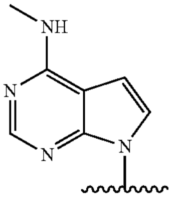
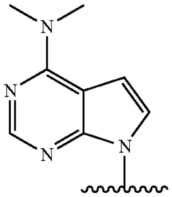
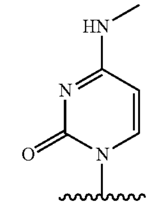
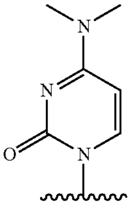
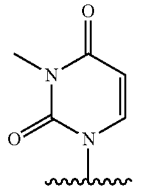
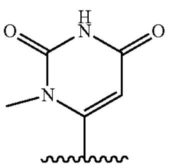
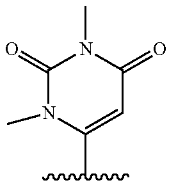
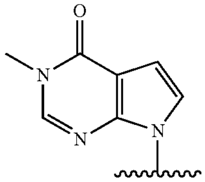

-continued

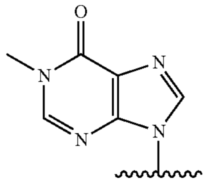

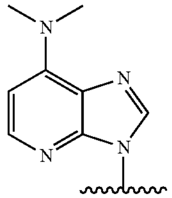

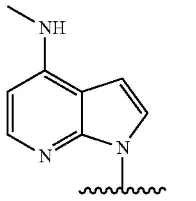

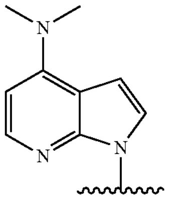

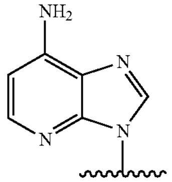

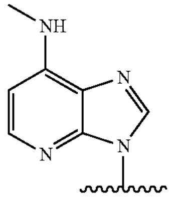

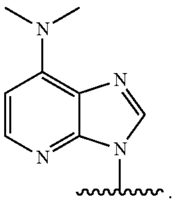

More examples of abasic nucleotide, acyclic nucleotide modifications (including UNA and GNA), and mismatch modifications have been described in detail in WO 2011/133876, which is herein incorporated by reference in its entirety.

The thermally destabilizing modifications may also include universal base with reduced or abolished capability to form hydrogen bonds with the opposing bases, and phosphate modifications.

In some embodiments, the thermally destabilizing modification of the duplex includes nucleotides with non-canonical bases such as, but not limited to, nucleobase modifications with impaired or completely abolished capability to form hydrogen bonds with bases in the opposite strand. These nucleobase modifications have been evaluated for destabilization of the central region of the dsRNA duplex as described in WO 2010/0011895, which is herein incorporated by reference in its entirety. Exemplary nucleobase modifications are:

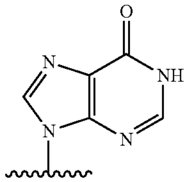

inosine

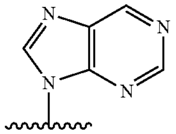

nebularine

-continued

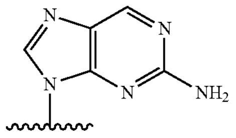

2-aminopurine

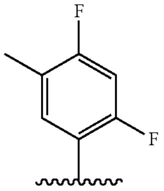

2,4-difluorotoluene

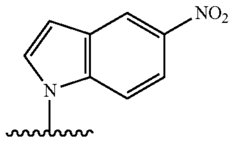

5-nitroindole

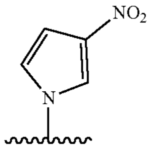

3-nitropyrrole

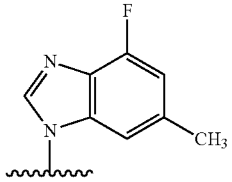

4-Fluoro-6-methylbenzimidazole

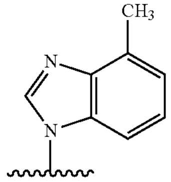

4-Methylbenzimidazole

In some embodiments, the thermally destabilizing modification of the duplex in the seed region of the antisense strand includes one or more α-nucleotide complementary to the base on the target mRNA, such as:

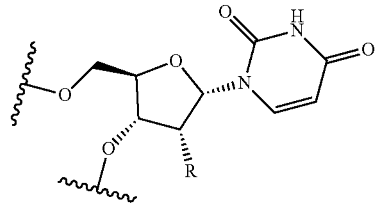

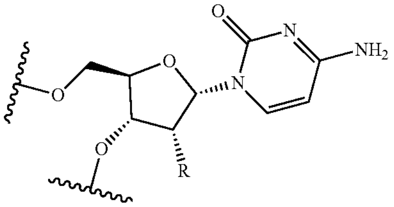

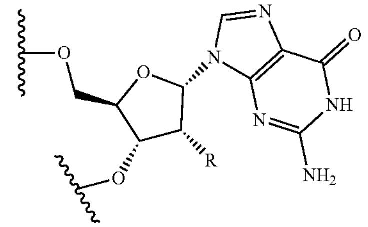

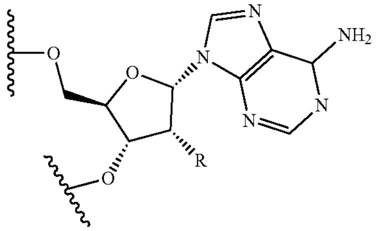

wherein R is H, OH, $OCH_3$, F, $NH_2$, NHMe, $NMe_2$ or O-alkyl.

Exemplary phosphate modifications known to decrease the thermal stability of dsRNA duplexes compared to natural phosphodiester linkages are:

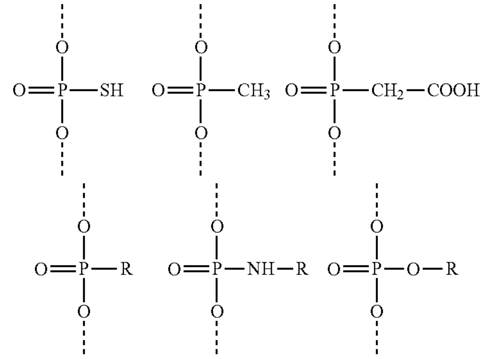

R = alkyl

The alkyl for the R group can be a $C_1$-$C_6$alkyl. Specific alkyls for the R group include, but are not limited to methyl, ethyl, propyl, isopropyl, butyl, pentyl and hexyl.

As the skilled artisan will recognize, in view of the functional role of nucleobases is defining specificity of an RNAi agent of the disclosure, while nucleobase modifications can be performed in the various manners as described herein, e.g., to introduce destabilizing modifications into an RNAi agent of the disclosure, e.g., for purpose of enhancing on-target effect relative to off-target effect, the range of modifications available and, in general, present upon RNAi agents of the disclosure tends to be much greater for non-nucleobase modifications, e.g., modifications to sugar groups or phosphate backbones of polyribonucleotides. Such modifications are described in greater detail in other sections of the instant disclosure and are expressly contemplated for RNAi agents of the disclosure, either possessing native nucleobases or modified nucleobases as described above or elsewhere herein.

In addition to the antisense strand comprising a thermally destabilizing modification, the dsRNA can also comprise one or more stabilizing modifications. For example, the dsRNA can comprise at least two (e.g., two, three, four, five, six, seven, eight, nine, ten or more) stabilizing modifications. Without limitations, the stabilizing modifications all can be present in one strand. In some embodiments, both the sense and the antisense strands comprise at least two stabilizing modifications. The stabilizing modification can occur on any nucleotide of the sense strand or antisense strand. For instance, the stabilizing modification can occur on every nucleotide on the sense strand or antisense strand; each stabilizing modification can occur in an alternating pattern on the sense strand or antisense strand; or the sense strand or antisense strand comprises both stabilizing modification in an alternating pattern. The alternating pattern of the stabilizing modifications on the sense strand may be the same or different from the antisense strand, and the alternating pattern of the stabilizing modifications on the sense strand can have a shift relative to the alternating pattern of the stabilizing modifications on the antisense strand.

In some embodiments, the antisense strand comprises at least two (e.g., two, three, four, five, six, seven, eight, nine, ten or more) stabilizing modifications. Without limitations, a stabilizing modification in the antisense strand can be present at any positions. In some embodiments, the antisense comprises stabilizing modifications at positions 2, 6, 8, 9, 14, and 16 from the 5'-end. In some other embodiments, the antisense comprises stabilizing modifications at positions 2, 6, 14, and 16 from the 5'-end. In still some other embodiments, the antisense comprises stabilizing modifications at positions 2, 14, and 16 from the 5'-end.

In some embodiments, the antisense strand comprises at least one stabilizing modification adjacent to the destabilizing modification. For example, the stabilizing modification can be the nucleotide at the 5'-end or the 3'-end of the destabilizing modification, i.e., at position −1 or +1 from the position of the destabilizing modification. In some embodiments, the antisense strand comprises a stabilizing modification at each of the 5'-end and the 3'-end of the destabilizing modification, i.e., positions −1 and +1 from the position of the destabilizing modification.

In some embodiments, the antisense strand comprises at least two stabilizing modifications at the 3'-end of the destabilizing modification, i.e., at positions +1 and +2 from the position of the destabilizing modification.

In some embodiments, the sense strand comprises at least two (e.g., two, three, four, five, six, seven, eight, nine, ten or more) stabilizing modifications. Without limitations, a stabilizing modification in the sense strand can be present at any positions. In some embodiments, the sense strand comprises stabilizing modifications at positions 7, 10, and 11 from the 5'-end. In some other embodiments, the sense strand comprises stabilizing modifications at positions 7, 9, 10, and 11 from the 5'-end. In some embodiments, the sense strand comprises stabilizing modifications at positions opposite or complementary to positions 11, 12, and 15 of the antisense strand, counting from the 5'-end of the antisense strand. In some other embodiments, the sense strand comprises stabilizing modifications at positions opposite or complementary to positions 11, 12, 13, and 15 of the antisense strand, counting from the 5'-end of the antisense strand. In some embodiments, the sense strand comprises a block of two, three, or four stabilizing modifications.

In some embodiments, the sense strand does not comprise a stabilizing modification in position opposite or complementary to the thermally destabilizing modification of the duplex in the antisense strand.

Exemplary thermally stabilizing modifications include, but are not limited to, 2'-fluoro modifications. Other thermally stabilizing modifications include, but are not limited to, LNA.

In some embodiments, the dsRNA of the disclosure comprises at least four (e.g., four, five, six, seven, eight, nine, ten, or more) 2'-fluoro nucleotides. Without limitations, the 2'-fluoro nucleotides all can be present in one strand. In some embodiments, both the sense and the antisense strands comprise at least two 2'-fluoro nucleotides. The 2'-fluoro modification can occur on any nucleotide of the sense strand or antisense strand. For instance, the 2'-fluoro modification can occur on every nucleotide on the sense strand or antisense strand; each 2'-fluoro modification can occur in an alternating pattern on the sense strand or antisense strand; or the sense strand or antisense strand comprises both 2'-fluoro modifications in an alternating pattern. The alternating pattern of the 2'-fluoro modifications on the sense strand may be the same or different from the antisense strand, and the alternating pattern of the 2'-fluoro modifications on the sense strand can have a shift relative to the alternating pattern of the 2'-fluoro modifications on the antisense strand.

In some embodiments, the antisense strand comprises at least two (e.g., two, three, four, five, six, seven, eight, nine, ten, or more) 2'-fluoro nucleotides. Without limitations, a 2'-fluoro modification in the antisense strand can be present at any positions. In some embodiments, the antisense comprises 2'-fluoro nucleotides at positions 2, 6, 8, 9, 14, and 16 from the 5'-end. In some other embodiments, the antisense comprises 2'-fluoro nucleotides at positions 2, 6, 14, and 16 from the 5'-end. In still some other embodiments, the antisense comprises 2'-fluoro nucleotides at positions 2, 14, and 16 from the 5'-end.

In some embodiments, the antisense strand comprises at least one 2'-fluoro nucleotide adjacent to the destabilizing modification. For example, the 2'-fluoro nucleotide can be the nucleotide at the 5'-end or the 3'-end of the destabilizing modification, i.e., at position −1 or +1 from the position of the destabilizing modification. In some embodiments, the antisense strand comprises a 2'-fluoro nucleotide at each of the 5'-end and the 3'-end of the destabilizing modification, i.e., positions −1 and +1 from the position of the destabilizing modification.

In some embodiments, the antisense strand comprises at least two 2'-fluoro nucleotides at the 3'-end of the destabilizing modification, i.e., at positions +1 and +2 from the position of the destabilizing modification.

In some embodiments, the sense strand comprises at least two (e.g., two, three, four, five, six, seven, eight, nine, ten or more) 2'-fluoro nucleotides. Without limitations, a 2'-fluoro modification in the sense strand can be present at any positions. In some embodiments, the antisense comprises 2'-fluoro nucleotides at positions 7, 10, and 11 from the 5'-end. In some other embodiments, the sense strand comprises 2'-fluoro nucleotides at positions 7, 9, 10, and 11 from the 5'-end. In some embodiments, the sense strand comprises 2'-fluoro nucleotides at positions opposite or complementary to positions 11, 12, and 15 of the antisense strand, counting from the 5'-end of the antisense strand. In some other embodiments, the sense strand comprises 2'-fluoro nucleotides at positions opposite or complementary to positions 11, 12, 13, and 15 of the antisense strand, counting from the 5'-end of the antisense strand. In some embodiments, the sense strand comprises a block of two, three or four 2'-fluoro nucleotides.

In some embodiments, the sense strand does not comprise a 2'-fluoro nucleotide in position opposite or complementary to the thermally destabilizing modification of the duplex in the antisense strand.

In some embodiments, the dsRNA molecule of the disclosure comprises a 21 nucleotides (nt) sense strand and a 23 nucleotides (nt) antisense, wherein the antisense strand contains at least one thermally destabilizing nucleotide, where the at least one thermally destabilizing nucleotide occurs in the seed region of the antisense strand (i.e., at position 2-9 of the 5'-end of the antisense strand), wherein one end of the dsRNA is blunt, while the other end is comprises a 2 nt overhang, and wherein the dsRNA optionally further has at least one (e.g., one, two, three, four, five, six or all seven) of the following characteristics: (i) the antisense comprises 2, 3, 4, 5 or 6 2'-fluoro modifications; (ii) the antisense comprises 1, 2, 3, 4 or 5 phosphorothioate internucleotide linkages; (iii) the sense strand is conjugated with a ligand; (iv) the sense strand comprises 2, 3, 4 or 5 2'-fluoro modifications; (v) the sense strand comprises 1, 2, 3, 4 or 5 phosphorothioate internucleotide linkages; (vi) the dsRNA comprises at least four 2'-fluoro modifications; and (vii) the dsRNA comprises a blunt end at 5'-end of the antisense strand. Preferably, the 2 nt overhang is at the 3'-end of the antisense.

In some embodiments, the dsRNA molecule of the disclosure comprising a sense and antisense strands, wherein: the sense strand is 25-30 nucleotide residues in length, wherein starting from the 5' terminal nucleotide (position 1), positions 1 to 23 of said sense strand comprise at least 8 ribonucleotides; antisense strand is 36-66 nucleotide residues in length and, starting from the 3' terminal nucleotide, at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when said double stranded nucleic acid is introduced into a mammalian cell; and wherein the antisense strand contains at least one thermally destabilizing nucleotide, where at least one thermally destabilizing nucleotide is in the seed region of the antisense strand (i.e. at position 2-9 of the 5'-end of the antisense strand). For example, the thermally destabilizing nucleotide occurs between positions opposite or complementary to positions 14-17 of the 5'-end of the sense strand, and wherein the dsRNA optionally further has at least one (e.g., one, two, three, four, five, six or all seven) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4, or 5 2'-fluoro modifications; (v) the sense strand comprises 1, 2, 3, 4, or 5 phosphorothioate internucleotide linkages; and (vi) the dsRNA comprises at least four 2'-fluoro modifications; and (vii) the dsRNA comprises a duplex region of 12-30 nucleotide pairs in length.

In some embodiments, the dsRNA molecule of the disclosure comprises a sense and antisense strands, wherein said dsRNA molecule comprises a sense strand having a length which is at least 25 and at most 29 nucleotides and an antisense strand having a length which is at most 30 nucleotides with the sense strand comprises a modified nucleotide that is susceptible to enzymatic degradation at position 11 from the 5'-end, wherein the 3' end of said sense strand and the 5' end of said antisense strand form a blunt end and said antisense strand is 1-4 nucleotides longer at its 3' end than the sense strand, wherein the duplex region which is at least 25 nucleotides in length, and said antisense strand is sufficiently complementary to a target mRNA along at least 19 nt of said antisense strand length to reduce target gene expression when said dsRNA molecule is introduced into a mammalian cell, and wherein dicer cleavage of said dsRNA preferentially results in an siRNA comprising said 3' end of said antisense strand, thereby reducing expression of the target gene in the mammal, wherein the antisense strand contains at least one thermally destabilizing nucleotide, where the at least one thermally destabilizing nucleotide is in the seed region of the antisense strand (i.e. at position 2-9 of the 5'-end of the antisense strand), and wherein the dsRNA optionally further has at least one (e.g., one, two, three, four, five, six or all seven) of the following characteristics: (i) the antisense comprises 2, 3, 4, 5, or 6 2'-fluoro modifications; (ii) the antisense comprises 1, 2, 3, 4, or 5 phosphorothioate internucleotide linkages; (iii) the sense strand is conjugated with a ligand; (iv) the sense strand comprises 2, 3, 4, or 5 2'-fluoro modifications; (v) the sense strand comprises 1, 2, 3, 4, or 5 phosphorothioate internucleotide linkages; and (vi) the dsRNA comprises at least four 2'-fluoro modifications; and (vii) the dsRNA has a duplex region of 12-29 nucleotide pairs in length.

In some embodiments, every nucleotide in the sense strand and antisense strand of the dsRNA molecule may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2' hydroxyl on the ribose sugar; wholesale replacement of the phosphate moiety with “dephospho” linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases, the modification will occur at all of the subject positions in the nucleic acid but in many cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of an RNA or may only occur in a single strand region of an RNA. E.g., a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. E.g., it can be desirable to include purine nucleotides in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with locked nucleic acid (LNA), unlocked nucleic acid (UNA), cyclohexene nucleic acid (CeNA), 2'-methoxyethyl, 2'-O-methyl, 2'-O-allyl, 2'-C-allyl, 2'-deoxy, or 2'-fluoro. The strands can contain more than one modification. In some embodiments, each residue of the sense strand and antisense strand is independently modified with 2'-O-methyl or 2'-fluoro. It is to be understood that these modifications are in addition to the at least one thermally destabilizing modification of the duplex present in the antisense strand.

At least two different modifications are typically present on the sense strand and antisense strand. Those two modifications may be the 2'-deoxy, 2'-O-methyl or 2'-fluoro modifications, acyclic nucleotides or others. In some embodiments, the sense strand and antisense strand each comprises two differently modified nucleotides selected from 2'-O-methyl or 2'-deoxy. In some embodiments, each residue of the sense strand and antisense strand is independently modified with 2-O-methyl nucleotide, 2'-deoxy nucleotide, 2'-deoxy-2'-fluoro nucleotide, 2'-O—N-methylacetamido (2'-O-NMA) nucleotide, a 2'-O-dimethylaminoethoxyethyl (2'-O-DMAEOE) nucleotide, 2'-O-aminopropyl (2'-O-AP) nucleotide, or 2'-ara-F nucleotide. Again, it is to be understood that these modifications are in addition to the at least one thermally destabilizing modification of the duplex present in the antisense strand.

In some embodiments, the dsRNA molecule of the disclosure comprises modifications of an alternating pattern, particular in the B1, B2, B3, B1', B2', B3', B4' regions. The term “alternating motif” or “alternative pattern” as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be “ABABABABABAB . . . ,” “AABBAABBAABB . . . ,” “AABAABAABAAB . . . ,” “AAABAAABAAAB . . . ,” “AAABBBAAABBB . . . ,” or “ABCABCABCABC . . . ,” etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as “ABABAB . . . ”, “ACACAC . . . ” “BDBDBD . . . ” or “CDCDCD . . . ,” etc.

In some embodiments, the dsRNA molecule of the disclosure comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with “ABABAB” from 5'-3' of the strand and the alternating motif in the antisense strand may start with “BABABA” from 3'-5' of the strand within the duplex region. As another example, the alternating motif in the sense strand may start with “AABBAABB” from 5'-3' of the strand and the alternating motif in the antisense strand may start with “BBAABBAA” from 3'-5' of the strand within the duplex region, so that there is a complete or partial shift of the modification patterns between the sense strand and the antisense strand.

In one particular example, the alternating motif in the sense strand is “ABABAB” from 5'-3' of the strand, where each A is an unmodified ribonucleotide and each B is a 2'-Omethyl modified nucleotide.

In one particular example, the alternating motif in the sense strand is "ABABAB" from 5'-3' of the strand, where each A is an 2'-deoxy-2'-fluoro modified nucleotide and each B is a 2'-Omethyl modified nucleotide.

In another particular example, the alternating motif in the antisense strand is "BABABA" from 3'-5' of the strand, where each A is a 2'-deoxy-2'-fluoro modified nucleotide and each B is a 2'-Omethyl modified nucleotide.

In one particular example, the alternating motif in the sense strand is "ABABAB" from 5'-3' of the strand and the alternating motif in the antisense strand is "BABABA" from 3'-5' of the strand, where each A is an unmodified ribonucleotide and each B is a 2'-Omethyl modified nucleotide.

In one particular example, the alternating motif in the sense strand is "ABABAB" from 5'-3' of the strand and the alternating motif in the antisense strand is "BABABA" from 3'-5' of the strand, where each A is a 2'-deoxy-2'-fluoro modified nucleotide and each B is a 2'-Omethyl modified nucleotide. The dsRNA molecule of the disclosure may further comprise at least one phosphorothioate or methylphosphonate internucleotide linkage. The phosphorothioate or methylphosphonate internucleotide linkage modification may occur on any nucleotide of the sense strand or antisense strand or both in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand comprises both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand.

In some embodiments, the dsRNA molecule comprises the phosphorothioate or methylphosphonate internucleotide linkage modification in the overhang region. For example, the overhang region comprises two nucleotides having a phosphorothioate or methylphosphonate internucleotide linkage between the two nucleotides. Internucleotide linkage modifications also may be made to link the overhang nucleotides with the terminal paired nucleotides within duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. Preferably, these terminal three nucleotides may be at the 3'-end of the antisense strand.

In some embodiments, the sense strand of the dsRNA molecule comprises 1-10 blocks of two to ten phosphorothioate or methylphosphonate internucleotide linkages separated by 1, 2, 3, 4, 5, 6, 7, 8, 9, 10, 11, 12, 13, 14, 15, or 16 phosphate internucleotide linkages, wherein one of the phosphorothioate or methylphosphonate internucleotide linkages is placed at any position in the oligonucleotide sequence and the said sense strand is paired with an antisense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of two phosphorothioate or methylphosphonate internucleotide linkages separated by 1, 2, 3, 4, 5, 6, 7, 8, 9, 10, 11, 12, 13, 14, 15, 16, 17, or 18 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of three phosphorothioate or methylphosphonate internucleotide linkages separated by 1, 2, 3, 4, 5, 6, 7, 8, 9, 10, 11, 12, 13, 14, 15, or 16 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of four phosphorothioate or methylphosphonate internucleotide linkages separated by 1, 2, 3, 4, 5, 6, 7, 8, 9, 10, 11, 12, 13, or 14 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of five phosphorothioate or methylphosphonate internucleotide linkages separated by 1, 2, 3, 4, 5, 6, 7, 8, 9, 10, 11, or 12 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of six phosphorothioate or methylphosphonate internucleotide linkages separated by 1, 2, 3, 4, 5, 6, 7, 8, 9, or 10 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of seven phosphorothioate or methylphosphonate internucleotide linkages separated by 1, 2, 3, 4, 5, 6, 7, or 8 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of eight phosphorothioate or methylphosphonate internucleotide linkages separated by 1, 2, 3, 4, 5, or 6 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the antisense strand of the dsRNA molecule comprises two blocks of nine phosphorothioate or methylphosphonate internucleotide linkages separated by 1, 2, 3, or 4 phosphate internucleotide linkages, wherein one of the phosphorothioate or methylphosphonate internucleotide linkages is placed at any position in the oligonucleotide sequence and the said antisense strand is paired with a sense strand comprising any combination of phosphorothioate, methylphosphonate and phosphate internucleotide linkages or an antisense strand comprising either phosphorothioate or methylphosphonate or phosphate linkage.

In some embodiments, the dsRNA molecule of the disclosure further comprises one or more phosphorothioate or methylphosphonate internucleotide linkage modification within 1-10 of the termini position(s) of the sense or antisense strand. For example, at least 2, 3, 4, 5, 6, 7, 8, 9, or 10 nucleotides may be linked through phosphorothioate or methylphosphonate internucleotide linkage at one end or both ends of the sense or antisense strand.

In some embodiments, the dsRNA molecule of the disclosure further comprises one or more phosphorothioate or methylphosphonate internucleotide linkage modification within 1-10 of the internal region of the duplex of each of the sense or antisense strand. For example, at least 2, 3, 4, 5, 6, 7, 8, 9, or 10 nucleotides may be linked through phosphorothioate methylphosphonate internucleotide linkage at position 8-16 of the duplex region counting from the 5'-end of the sense strand; the dsRNA molecule can optionally further comprise one or more phosphorothioate or methylphosphonate internucleotide linkage modification within 1-10 of the termini position(s).

In some embodiments, the dsRNA molecule of the disclosure further comprises one to five phosphorothioate or methylphosphonate internucleotide linkage modification(s) within position 1-5 and one to five phosphorothioate or methylphosphonate internucleotide linkage modification(s) within position 18-23 of the sense strand (counting from the 5'-end), and one to five phosphorothioate or methylphosphonate internucleotide linkage modifications at positions 1 and 2 and one to five within positions 18-23 of the antisense strand (counting from the 5'-end).

In some embodiments, the dsRNA molecule of the disclosure further comprises one phosphorothioate internucleotide linkage modification within position 1-5 and one phosphorothioate or methylphosphonate internucleotide linkage modification within position 18-23 of the sense strand (counting from the 5'-end), and one phosphorothioate internucleotide linkage modification at position 1 or 2 and two phosphorothioate or methylphosphonate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and one phosphorothioate internucleotide linkage modification within position 18-23 of the sense strand (counting from the 5'-end), and one phosphorothioate internucleotide linkage modification at position 1 or 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at position 1 or 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within position 1-5 and two phosphorothioate internucleotide linkage modifications within position 18-23 of the sense strand (counting from the 5'-end), and one phosphorothioate internucleotide linkage modification at position 1 or 2 and one phosphorothioate internucleotide linkage modification within positions 18-23 of the antisense strand (counting from the 5'-end).

In some embodiments, the dsRNA molecule of the disclosure further comprises one phosphorothioate internucleotide linkage modification within position 1-5 and one phosphorothioate internucleotide linkage modification within position 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA molecule of the disclosure further comprises one phosphorothioate internucleotide linkage modification within position 1-5 and one within position 18-23 of the sense strand (counting from the 5'-end), and two phosphorothioate internucleotide linkage modifications at positions 1 and 2 and one phosphorothioate internucleotide linkage modification within positions 18-23 of the antisense strand (counting from the 5'-end).

In some embodiments, the dsRNA molecule of the disclosure further comprises one phosphorothioate internucleotide linkage modification within position 1-5 (counting from the 5'-end) of the sense strand, and two phosphorothioate internucleotide linkage modifications at positions 1 and 2 and one phosphorothioate internucleotide linkage modification within positions 18-23 of the antisense strand (counting from the 5'-end).

In some embodiments, the dsRNA molecule of the disclosure further comprises two phosphorothioate internucleotide linkage modifications within position 1-5 (counting from the 5'-end) of the sense strand, and one phosphorothioate internucleotide linkage modification at position 1 or 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within positions 1-5 and one within positions 18-23 of the sense strand (counting from the 5'-end), and two phosphorothioate internucleotide linkage modifications at positions 1 and 2 and one phosphorothioate internucleotide linkage modification within positions 18-23 of the antisense strand (counting from the 5'-end).

In some embodiments, the dsRNA molecule of the disclosure further comprises two phosphorothioate internucleotide linkage modifications within positions 1-5 and one phosphorothioate internucleotide linkage modification within positions 18-23 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications within positions 1-5 and one phosphorothioate internucleotide linkage modification within positions 18-23 of the sense strand (counting from the 5'-end), and one phosphorothioate internucleotide linkage modification at position 1 or 2 and two phosphorothioate internucleotide linkage modifications within positions 18-23 of the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at positions 20 and 21 of the sense strand (counting from the 5'-end), and one phosphorothioate internucleotide linkage modification at position 1 and one at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 20 and 21 the antisense strand (counting from the 5'-end).

In some embodiments, the dsRNA molecule of the disclosure further comprises two phosphorothioate internucleotide linkage modifications at position 1 and 2, and two phosphorothioate internucleotide linkage modifications at position 21 and 22 of the sense strand (counting from the 5'-end), and one phosphorothioate internucleotide linkage modification at positions 1 and one phosphorothioate internucleotide linkage modification at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 21 and 22 of the antisense strand (counting from the 5'-end).

In some embodiments, the dsRNA molecule of the disclosure further comprises two phosphorothioate internucleotide linkage modifications at positions 1 and 2, and two phosphorothioate internucleotide linkage modifications at position 22 and 23 of the sense strand (counting from the 5'-end), and one phosphorothioate internucleotide linkage modification at position 1 and one phosphorothioate internucleotide linkage modification at position 21 of the antisense strand (counting from the 5'-end).

In some embodiments, the dsRNA molecule of the disclosure further comprises one phosphorothioate internucleotide linkage modification at position 1, and one phosphorothioate internucleotide linkage modification at position 21 of the sense strand (counting from the 5'-end), and two phosphorothioate internucleotide linkage modifications at positions 1 and 2 and two phosphorothioate internucleotide linkage modifications at positions 21 and 22 of the antisense strand (counting from the 5'-end).

In some embodiments, a compound of the disclosure comprises a pattern of backbone chiral centers. In some embodiments, a common pattern of backbone chiral centers comprises at least 5 internucleotidic linkages in the Sp configuration. In some embodiments, a common pattern of backbone chiral centers comprises at least 6 internucleotidic linkages in the Sp configuration. In some embodiments, a common pattern of backbone chiral centers comprises at least 7 internucleotidic linkages in the Sp configuration. In some embodiments, a common pattern of backbone chiral centers comprises at least 8 internucleotidic linkages in the Sp configuration. In some embodiments, a common pattern of backbone chiral centers comprises at least 9 internucleotidic linkages in the Sp configuration.

In some embodiments, a common pattern of backbone chiral centers comprises at least 10 internucleotidic linkages in the Sp configuration. In some embodiments, a common pattern of backbone chiral centers comprises at least 11 internucleotidic linkages in the Sp configuration. In some embodiments, a common pattern of backbone chiral centers comprises at least 12 internucleotidic linkages in the Sp configuration. In some embodiments, a common pattern of backbone chiral centers comprises at least 13 internucleotidic linkages in the Sp configuration. In some embodiments, a common pattern of backbone chiral centers comprises at least 14 internucleotidic linkages in the Sp configuration. In some embodiments, a common pattern of backbone chiral centers comprises at least 15 internucleotidic linkages in the Sp configuration. In some embodiments, a common pattern of backbone chiral centers comprises at least 16 internucleotidic linkages in the Sp configuration. In some embodiments, a common pattern of backbone chiral centers comprises at least 17 internucleotidic linkages in the Sp configuration. In some embodiments, a common pattern of backbone chiral centers comprises at least 18 internucleotidic linkages in the Sp configuration. In some embodiments, a common pattern of backbone chiral centers comprises at least 19 internucleotidic linkages in the Sp configuration. In some embodiments, a common pattern of backbone chiral centers comprises no more than 8 internucleotidic linkages in the Rp configuration. In some embodiments, a common pattern of backbone chiral centers comprises no more than 7 internucleotidic linkages in the Rp configuration. In some embodiments, a common pattern of backbone chiral centers comprises no more than 6 internucleotidic linkages in the Rp configuration. In some embodiments, a common pattern of backbone chiral centers comprises no more than 5 internucleotidic linkages in the Rp configuration. In some embodiments, a common pattern of backbone chiral centers comprises no more than 4 internucleotidic linkages in the Rp configuration. In some embodiments, a common pattern of backbone chiral centers comprises no more than 3 internucleotidic linkages in the Rp configuration. In some embodiments, a common pattern of backbone chiral centers comprises no more than 2 internucleotidic linkages in the Rp configuration. In some embodiments, a common pattern of backbone chiral centers comprises no more than 1 internucleotidic linkages in the Rp configuration. In some embodiments, a common pattern of backbone chiral centers comprises no more than 8 internucleotidic linkages which are not chiral (as a non-limiting example, a phosphodiester). In some embodiments, a common pattern of backbone chiral centers comprises no more than 7 internucleotidic linkages which are not chiral. In some embodiments, a common pattern of backbone chiral centers comprises no more than 6 internucleotidic linkages which are not chiral. In some embodiments, a common pattern of backbone chiral centers comprises no more than 5 internucleotidic linkages which are not chiral. In some embodiments, a common pattern of backbone chiral centers comprises no more than 4 internucleotidic linkages which are not chiral. In some embodiments, a common pattern of backbone chiral centers comprises no more than 3 internucleotidic linkages which are not chiral. In some embodiments, a common pattern of backbone chiral centers comprises no more than 2 internucleotidic linkages which are not chiral. In some embodiments, a common pattern of backbone chiral centers comprises no more than 1 internucleotidic linkages which are not chiral. In some embodiments, a common pattern of backbone chiral centers comprises at least 10 internucleotidic linkages in the Sp configuration, and no more than 8 internucleotidic linkages which are not chiral. In some embodiments, a common pattern of backbone chiral centers comprises at least 11 internucleotidic linkages in the Sp configuration, and no more than 7 internucleotidic linkages which are not chiral. In some embodiments, a common pattern of backbone chiral centers comprises at least 12 internucleotidic linkages in the Sp configuration, and no more than 6 internucleotidic linkages which are not chiral. In some embodiments, a common pattern of backbone chiral centers comprises at least 13 internucleotidic linkages in the Sp configuration, and no more than 6 internucleotidic linkages which are not chiral. In some embodiments, a common pattern of backbone chiral centers comprises at least 14 internucleotidic linkages in the Sp configuration, and no more than 5 internucleotidic linkages which are not chiral. In some embodiments, a common pattern of backbone chiral centers comprises at least 15 internucleotidic linkages in the Sp configuration, and no more than 4 internucleotidic linkages which are not chiral. In some embodiments, the internucleotidic linkages in the Sp configuration are optionally contiguous or not contiguous. In some embodiments, the internucleotidic linkages in the Rp configuration are optionally contiguous or not contiguous. In some embodiments, the internucleotidic linkages which are not chiral are optionally contiguous or not contiguous.

In some embodiments, a compound of the disclosure comprises a block that is a stereochemistry block. In some embodiments, a block is an Rp block in that each internucleotidic linkage of the block is Rp. In some embodiments, a 5'-block is an Rp block. In some embodiments, a 3'-block is an Rp block. In some embodiments, a block is an Sp block in that each internucleotidic linkage of the block is Sp. In some embodiments, a 5'-block is an Sp block. In some embodiments, a 3'-block is an Sp block. In some embodiments, provided oligonucleotides comprise both Rp and Sp blocks. In some embodiments, provided oligonucleotides comprise one or more Rp but no Sp blocks. In some embodiments, provided oligonucleotides comprise one or more Sp but no Rp blocks. In some embodiments, provided oligonucleotides comprise one or more PO blocks wherein each internucleotidic linkage in a natural phosphate linkage.

In some embodiments, a compound of the disclosure comprises a 5'-block that is an Sp block wherein each sugar moiety comprises a 2'-F modification. In some embodiments, a 5'-block is an Sp block wherein each of internucleotidic linkage is a modified internucleotidic linkage and each sugar moiety comprises a 2'-F modification. In some embodiments, a 5'-block is an Sp block wherein each of internucleotidic linkage is a phosphorothioate linkage and each sugar moiety comprises a 2'-F modification. In some embodiments, a 5'-block comprises 4 or more nucleoside units. In some embodiments, a 5'-block comprises 5 or more nucleoside units. In some embodiments, a 5'-block comprises 6 or more nucleoside units. In some embodiments, a 5'-block comprises 7 or more nucleoside units. In some embodiments, a 3'-block is an Sp block wherein each sugar moiety comprises a 2'-F modification. In some embodiments, a 3'-block is an Sp block wherein each of internucleotidic linkage is a modified internucleotidic linkage and each sugar moiety comprises a 2'-F modification. In some embodiments, a 3'-block is an Sp block wherein each of internucleotidic linkage is a phosphorothioate linkage and each sugar moiety comprises a 2'-F modification. In some embodiments, a 3'-block comprises 4 or more nucleoside units. In some embodiments, a 3'-block comprises 5 or more nucleoside units. In some embodiments, a 3'-block comprises 6 or more nucleoside units. In some embodiments, a 3'-block comprises 7 or more nucleoside units.

In some embodiments, a compound of the disclosure comprises a type of nucleoside in a region or an oligonucleotide that is followed by a specific type of internucleotidic linkage, e.g., natural phosphate linkage, modified internucleotidic linkage, Rp chiral internucleotidic linkage, Sp chiral internucleotidic linkage, etc. In some embodiments, A is followed by Sp. In some embodiments, A is followed by Rp. In some embodiments, A is followed by natural phosphate linkage (PO). In some embodiments, U is followed by Sp. In some embodiments, U is followed by Rp. In some embodiments, U is followed by natural phosphate linkage (PO). In some embodiments, C is followed by Sp. In some embodiments, C is followed by Rp. In some embodiments, C is followed by natural phosphate linkage (PO). In some embodiments, G is followed by Sp. In some embodiments, G is followed by Rp. In some embodiments, G is followed by natural phosphate linkage (PO). In some embodiments, C and U are followed by Sp. In some embodiments, C and U are followed by Rp. In some embodiments, C and U are followed by natural phosphate linkage (PO). In some embodiments, A and G are followed by Sp. In some embodiments, A and G are followed by Rp.

In some embodiments, the antisense strand comprises phosphorothioate internucleotide linkages between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5 or 6 2'-fluoro modifications; (ii) the antisense comprises 3, 4 or 5 phosphorothioate internucleotide linkages; (iii) the sense strand is conjugated with a ligand; (iv) the sense strand comprises 2, 3, 4 or 5 2'-fluoro modifications; (v) the sense strand comprises 1, 2, 3, 4 or 5 phosphorothioate internucleotide linkages; (vi) the dsRNA comprises at least four 2'-fluoro modifications; (vii) the dsRNA comprises a duplex region of 12-40 nucleotide pairs in length; and (viii) the dsRNA has a blunt end at 5'-end of the antisense strand.

In some embodiments, the antisense strand comprises phosphorothioate internucleotide linkages between nucleotide positions 1 and 2, between nucleotide positions 2 and 3, between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5 or 6 2'-fluoro modifications; (ii) the sense strand is conjugated with a ligand; (iii) the sense strand comprises 2, 3, 4 or 5 2'-fluoro modifications; (iv) the sense strand comprises 1, 2, 3, 4 or 5 phosphorothioate internucleotide linkages; (v) the dsRNA comprises at least four 2'-fluoro modifications; (vi) the dsRNA comprises a duplex region of 12-40 nucleotide pairs in length; (vii) the dsRNA comprises a duplex region of 12-40 nucleotide pairs in length; and (viii) the dsRNA has a blunt end at 5'-end of the antisense strand.

In some embodiments, the sense strand comprises phosphorothioate internucleotide linkages between nucleotide positions 1 and 2, and between nucleotide positions 2 and 3, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six, seven or all eight) of the following characteristics: (i) the antisense comprises 2, 3, 4, 5 or 6 2'-fluoro modifications; (ii) the antisense comprises 1, 2, 3, 4 or 5 phosphorothioate internucleotide linkages; (iii) the sense strand is conjugated with a ligand; (iv) the sense strand comprises 2, 3, 4 or 5 2'-fluoro modifications; (v) the sense strand comprises 3, 4 or 5 phosphorothioate internucleotide linkages; (vi) the dsRNA comprises at least four 2'-fluoro modifications; (vii) the dsRNA comprises a duplex region of 12-40 nucleotide pairs in length; and (viii) the dsRNA has a blunt end at 5'-end of the antisense strand.

In some embodiments, the sense strand comprises phosphorothioate internucleotide linkages between nucleotide positions 1 and 2, and between nucleotide positions 2 and 3, the antisense strand comprises phosphorothioate internucleotide linkages between nucleotide positions 1 and 2, between nucleotide positions 2 and 3, between nucleotide positions 21 and 22, and between nucleotide positions 22 and 23, wherein the antisense strand contains at least one thermally destabilizing modification of the duplex located in the seed region of the antisense strand (i.e., at position 2-9 of the 5'-end of the antisense strand), and wherein the dsRNA optionally further has at least one (e.g., one, two, three, four, five, six or all seven) of the following characteristics: (i) the antisense comprises 2, 3, 4, 5 or 6 2'-fluoro modifications; (ii) the sense strand is conjugated with a ligand; (iii) the sense strand comprises 2, 3, 4 or 5 2'-fluoro modifications; (iv) the sense strand comprises 3, 4 or 5 phosphorothioate internucleotide linkages; (v) the dsRNA comprises at least four 2'-fluoro modifications; (vi) the dsRNA comprises a duplex region of 12-40 nucleotide pairs in length; and (vii) the dsRNA has a blunt end at 5'-end of the antisense strand.

In some embodiments, the dsRNA molecule of the disclosure comprises mismatch(es) with the target, within the duplex, or combinations thereof. The mismatch can occur in the overhang region or the duplex region. The base pair can be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In some embodiments, the dsRNA molecule of the disclosure comprises at least one of the first 1, 2, 3, 4, or 5 base pairs within the duplex regions from the 5'-end of the antisense strand can be chosen independently from the group of A:U, G:U, I:C, and mismatched pairs, e.g., non-canonical or other than canonical pairings or pairings which include a universal base, to promote the dissociation of the antisense strand at the 5'-end of the duplex.

In some embodiments, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

It was found that introducing 4'-modified or 5'-modified nucleotide to the 3'-end of a phosphodiester (PO), phosphorothioate (PS), or phosphorodithioate (PS2) linkage of a dinucleotide at any position of single stranded or double stranded oligonucleotide can exert steric effect to the internucleotide linkage and, hence, protecting or stabilizing it against nucleases. In some embodiments, the introduction of a 4'-modified or a 5'-modified nucleotide to the 3'-end of a PO, PS, or PS2 linkage of a dinucleotide modifies the second nucleotide in the dinucleotide pair. In other embodiments, the introduction of a 4'-modified or a 5'-modified nucleotide to the 3'-end of a PO, PS, or PS2 linkage of a dinucleotide modifies the nucleotide at the 3'-end of the dinucleotide pair.

In some embodiments, 5'-modified nucleotide is introduced at the 3'-end of a dinucleotide at any position of single stranded or double stranded siRNA. For instance, a 5'-alkylated nucleoside may be introduced at the 3'-end of a dinucleotide at any position of single stranded or double stranded siRNA. The alkyl group at the 5' position of the ribose sugar can be racemic or chirally pure R or S isomer. An exemplary 5'-alkylated nucleotide is 5'-methyl nucleoside. The 5'-methyl can be either racemic or chirally pure R or S isomer.

In some embodiments, 4'-modified nucleotide is introduced at the 3'-end of a dinucleotide at any position of single stranded or double stranded siRNA. For instance, a 4'-alkylated nucleoside may be introduced at the 3'-end of a dinucleotide at any position of single stranded or double stranded siRNA. The alkyl group at the 4' position of the ribose sugar can be racemic or chirally pure R or S isomer. An exemplary 4'-alkylated nucleotide is 4'-methyl nucleoside. The 4'-methyl can be either racemic or chirally pure R or S isomer. Alternatively, a 4'-O-alkylated nucleoside may be introduced at the 3'-end of a dinucleotide at any position of single stranded or double stranded siRNA. The 4'-O-alkyl of the ribose sugar can be racemic or chirally pure R or S isomer. An exemplary 4'-O-alkylated nucleotide is 4'-O-methyl nucleoside. The 4'-O-methyl can be either racemic or chirally pure R or S isomer.

In some embodiments, 5'-alkylated nucleotide is introduced at any position on the sense strand or antisense strand of a dsRNA, and such modification maintains or improves potency of the dsRNA. The 5'-alkyl can be either racemic or chirally pure R or S isomer. An exemplary 5'-alkylated nucleotide is 5'-methyl nucleoside. The 5'-methyl can be either racemic or chirally pure R or S isomer.

In some embodiments, 4'-alkylated nucleotide is introduced at any position on the sense strand or antisense strand of a dsRNA, and such modification maintains or improves potency of the dsRNA. The 4'-alkyl can be either racemic or chirally pure R or S isomer. An exemplary 4'-alkylated nucleotide is 4'-methyl nucleoside. The 4'-methyl can be either racemic or chirally pure R or S isomer.

In some embodiments, 4'-O-alkylated nucleotide is introduced at any position on the sense strand or antisense strand of a dsRNA, and such modification maintains or improves potency of the dsRNA. The 5'-alkyl can be either racemic or chirally pure R or S isomer. An exemplary 4'-O-alkylated nucleotide is 4'-O-methyl nucleoside. The 4'-O-methyl can be either racemic or chirally pure R or S isomer.

In some embodiments, the dsRNA molecule of the disclosure can comprise 2'-5' linkages (with 2'-H, 2'-OH and 2'-OMe and with P═O or P═S). For example, the 2'-5' linkages modifications can be used to promote nuclease resistance or to inhibit binding of the sense to the antisense strand, or can be used at the 5' end of the sense strand to avoid sense strand activation by RISC.

In another embodiment, the dsRNA molecule of the disclosure can comprise L sugars (e.g., L ribose, L-arabinose with 2'-H, 2'-OH and 2'-OMe). For example, these L sugars modifications can be used to promote nuclease resistance or to inhibit binding of the sense to the antisense strand, or can be used at the 5' end of the sense strand to avoid sense strand activation by RISC.

Various publications describe multimeric siRNA which can all be used with the dsRNA of the disclosure. Such publications include WO2007/091269, U.S. Pat. No. 7,858, 769, WO2010/141511, WO2007/117686, WO2009/014887, and WO2011/031520 which are hereby incorporated by their entirely.

As described in more detail below, the RNAi agent that contains conjugations of one or more carbohydrate moieties to an RNAi agent can optimize one or more properties of the RNAi agent. In many cases, the carbohydrate moiety will be attached to a modified subunit of the RNAi agent. For example, the ribose sugar of one or more ribonucleotide subunits of a dsRNA agent can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The RNAi agents may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and decalin; preferably, the acyclic group is selected from serinol backbone or diethanolamine backbone.

In certain specific embodiments, the RNAi agent for use in the methods of the disclosure is an agent selected from the group of agents listed in any one of Tables 3-6. These agents may further comprise a ligand.

IV. iRNAs Conjugated to Ligands

Another modification of the RNA of an iRNA of the invention involves chemically linking to the iRNA one or more ligands, moieties or conjugates that enhance the activity, cellular distribution or cellular uptake of the iRNA, e.g., into a cell. Such moieties include but are not limited to lipid moieties such as a cholesterol moiety (Letsinger et al., *Proc. Natl. Acid. Sci. USA,* 1989, 86: 6553-6556), cholic acid (Manoharan et al., *Biorg. Med. Chem. Let.,* 1994, 4:1053-1060), a thioether, e.g., beryl-S-tritylthiol (Manoharan et al., *Ann. N.Y. Acad. Sci.,* 1992, 660:306-309; Manoharan et al., *Biorg. Med. Chem. Let.,* 1993, 3:2765-2770), a thiocholesterol (Oberhauser et al., *Nucl. Acids Res.,* 1992, 20:533-538), an aliphatic chain, e.g., dodecandiol or undecyl residues (Saison-Behmoaras et al., *EMBO J,* 1991, 10:1111-1118; Kabanov et al., *FEBS Lett.,* 1990, 259:327-330; Svinarchuk et al., *Biochimie,* 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.,* 1995, 36:3651-3654; Shea et al., *Nucl. Acids Res.,* 1990, 18:3777-3783), a polyamine or a polyethylene glycol chain (Manoharan et al., *Nucleosides & Nucleotides,* 1995, 14:969-973), or adamantane acetic acid (Manoharan et al., *Tetrahedron Lett.,* 1995, 36:3651-3654), a palmityl moiety (Mishra et al., *Biochim. Biophys. Acta,* 1995, 1264:229-237), or an octadecylamine or hexylaminocarbonyloxycholesterol moiety (Crooke et al., *J. Pharmacol. Exp. Ther.,* 1996, 277:923-937).

In certain embodiments, a ligand alters the distribution, targeting or lifetime of an iRNA agent into which it is incorporated. In some embodiments, a ligand provides an enhanced affinity for a selected target, e.g., molecule, cell or cell type, compartment, e.g., a cellular or organ compartment, tissue, organ or region of the body, as, e.g., compared to a species absent such a ligand. Typical ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl) methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an α helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, or an RGD peptide or RGD peptide mimetic. In certain embodiments, the ligand is a multivalent galactose, e.g., an N-acetyl-galactosamine.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, bomeol, menthol, 1,3-propanediol, heptadecyl group, palmitic acid, myristic acid, O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, $[MPEG]_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Ligands may also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated iRNAs of the invention may be synthesized by the use of an oligonucleotide that bears a pendant reactive functionality, such as that derived from the attachment of a linking molecule onto the oligonucleotide (described below). This reactive oligonucleotide may be reacted directly with commercially available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems® (Foster City, Calif). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In certain embodiments, the ligand or conjugate is a lipid or lipid-based molecule. Such a lipid or lipid-based molecule can typically bind a serum protein, such as human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, or (c) can be used to adjust binding to a serum protein, e.g., HSA.

A lipid-based ligand can be used to modulate, e.g., control (e.g., inhibit) the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In certain embodiments, the lipid-based ligand binds HSA. For example, the ligand can bind HSA with a sufficient affinity such that distribution of the conjugate to a non-kidney tissue is enhanced. However, the affinity is typically not so strong that the HSA-ligand binding cannot be reversed.

In certain embodiments, the lipid-based ligand binds HSA weakly or not at all, such that distribution of the conjugate to the kidney is enhanced. Other moieties that target to kidney cells can also be used in place of or in addition to the lipid-based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by cancer cells. Also included are HSA and low density lipoprotein (LDL).

B. Cell Permeation Agents

In another aspect, the ligand is a cell-permeation agent, such as a helical cell-permeation agent. In certain embodiments, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is typically an α-helical agent and can have a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp, or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 993). An RFGF analogue (e.g., amino acid sequence AALLPVLLAAP (SEQ ID NO: 994)) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 995)) and the *Drosophila* Antennapedia protein (RQIKIWFQNRRMKWKK (SEQ ID NO: 996)) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., *Nature,* 354:82-84, 1991). Typically, the peptide or peptidomimetic tethered to a dsRNA agent via an incorporated monomer unit is a cell targeting peptide such as an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand. Preferred conjugates of this ligand target PECAM-1 or VEGF.

An RGD peptide moiety can be used to target a particular cell type, e.g., a tumor cell, such as an endothelial tumor cell or a breast cancer tumor cell (Zitzmann et al., *Cancer Res.,* 62:5139-43, 2002). An RGD peptide can facilitate targeting of an dsRNA agent to tumors of a variety of other tissues, including the lung, kidney, spleen, or liver (Aoki et al., *Cancer Gene Therapy* 8:783-787, 2001). Typically, the RGD peptide will facilitate targeting of an iRNA agent to the kidney. T6he RGD peptide can be linear or cyclic, and can be modified, e.g., glycosylated or methylated to facilitate targeting to specific tissues. For example, a glycosylated RGD peptide can deliver an iRNA agent to a tumor cell expressing $\alpha_V\beta_3$ (Haubner et al., *Jour. Nucl. Med.,* 42:326-336, 2001).

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., *Nucl. Acids Res.* 31:2717-2724, 2003).

C. Carbohydrate Conjugates

In some embodiments of the compositions and methods of the invention, an iRNA further comprises a carbohydrate. The carbohydrate conjugated iRNA are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and tri-saccharides include sugars having two or three monosaccharide units (e.g., C5, C6, C7, or C8).

In certain embodiments, a carbohydrate conjugate comprises a monosaccharide.

In certain embodiments, the monosaccharide is an N-acetylgalactosamine (GalNAc). GalNAc conjugates, which comprise one or more N-acetylgalactosamine (GalNAc) derivatives, are described, for example, in U.S. Pat. No. 8,106,022, the entire content of which is hereby incorporated herein by reference. In some embodiments, the GalNAc conjugate serves as a ligand that targets the iRNA to particular cells. In some embodiments, the GalNAc conjugate targets the iRNA to liver cells, e.g., by serving as a ligand for the asialoglycoprotein receptor of liver cells (e.g., hepatocytes).

In some embodiments, the carbohydrate conjugate comprises one or more GalNAc derivatives. The GalNAc derivatives may be attached via a linker, e.g., a bivalent or trivalent branched linker. In some embodiments the GalNAc conjugate is conjugated to the 3' end of the sense strand. In some embodiments, the GalNAc conjugate is conjugated to the iRNA agent (e.g., to the 3' end of the sense strand) via a linker, e.g., a linker as described herein. In some embodiments the GalNAc conjugate is conjugated to the 5' end of the sense strand. In some embodiments, the GalNAc conjugate is conjugated to the iRNA agent (e.g., to the 5' end of the sense strand) via a linker, e.g., a linker as described herein.

the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker. In other embodiments of the invention, the GalNAc or GalNAc derivative is attached to an iRNA agent of the invention via a tetravalent linker.

In certain embodiments, the double stranded RNAi agents of the invention comprise one GalNAc or GalNAc derivative attached to the iRNA agent. In certain embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, the GalNAc conjugate is

Formula II

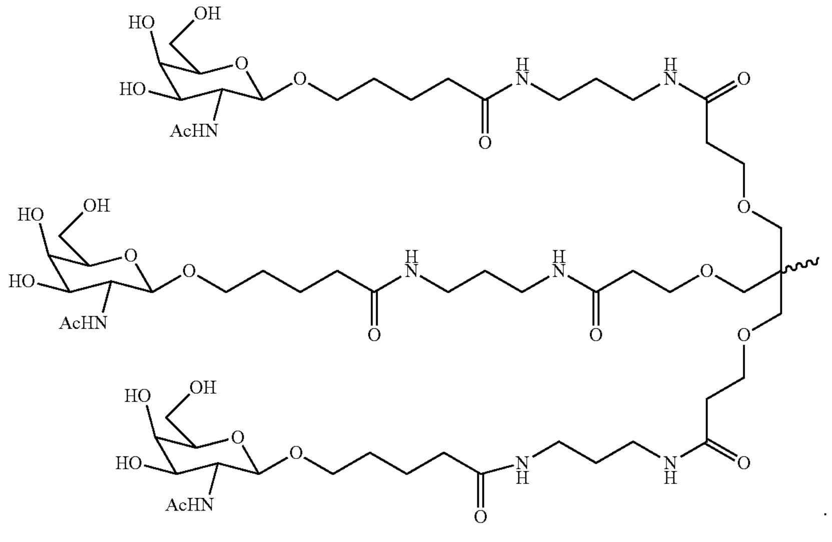

In certain embodiments of the invention, the GalNAc or GalNAc derivative is attached to an iRNA agent of the invention via a monovalent linker. In some embodiments, In some embodiments, the RNAi agent is attached to the carbohydrate conjugate via a linker as shown in the following schematic, wherein X is O or S

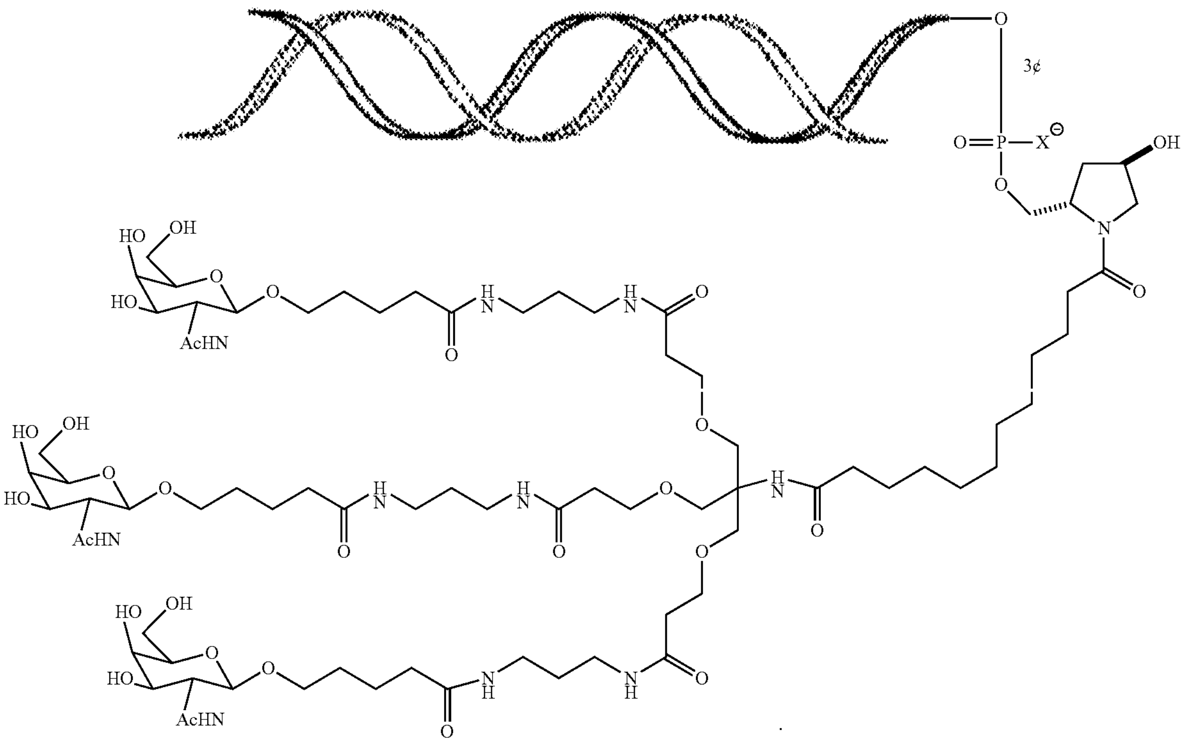
In some embodiments, the RNAi agent is conjugated to L96 as defined in Table 2 and shown below:

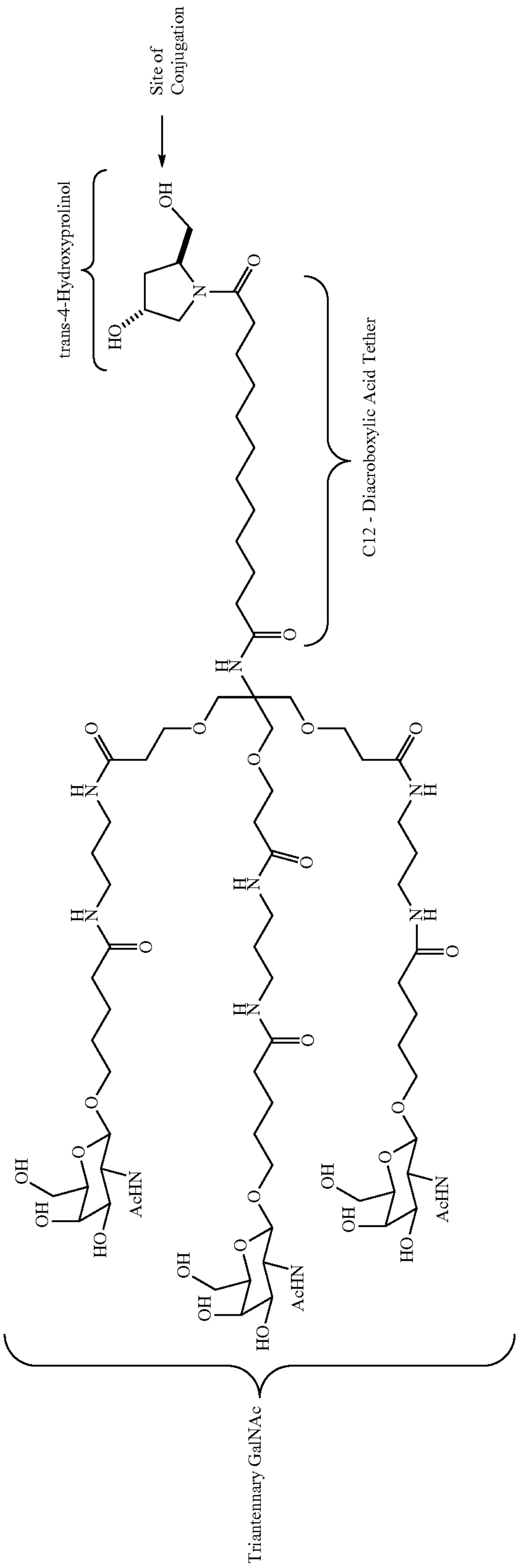
trans-4-Hydroxyprolinol
Site of Conjugation
C12 - Diacroboxylic Acid Tether
Triantennary GalNAc In some embodiments, the RNAi agent may comprise a 3'-terminal L96-modified nucleotide, such as, for example uL96 shown below:

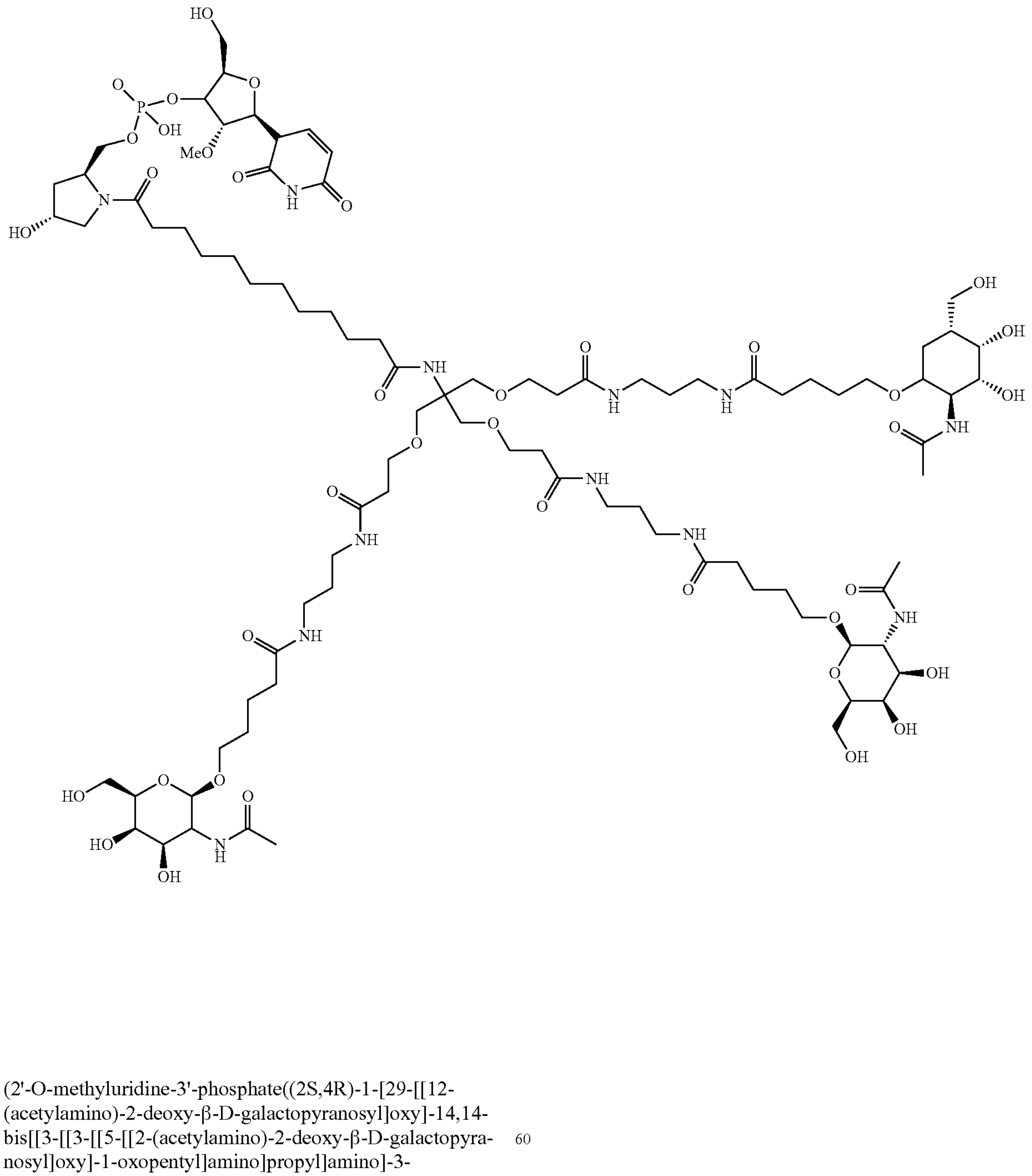

(2'-O-methyluridine-3'-phosphate((2S,4R)-1-[29-[[12-(acetylamino)-2-deoxy-β-D-galactopyranosyl]oxy]-14,14-bis[[3-[[3-[[5-[[2-(acetylamino)-2-deoxy-β-D-galactopyranosyl]oxy]-1-oxopentyl]amino]propyl]amino]-3-oxopropoxy]methyl]-1,12,19,25-tetraoxo-16-oxa-13,20,24-triazanonacos-1-yl]-4-hydroxy-2-pyrrolidinyl)methyl ester).

In certain embodiments, a carbohydrate conjugate for use in the compositions and methods of the invention is selected from the group consisting of:

Formula II
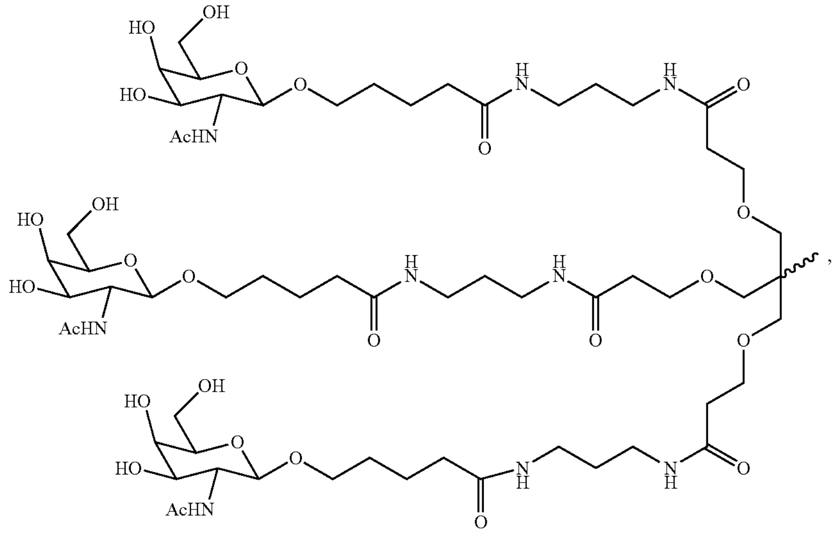
Formula III
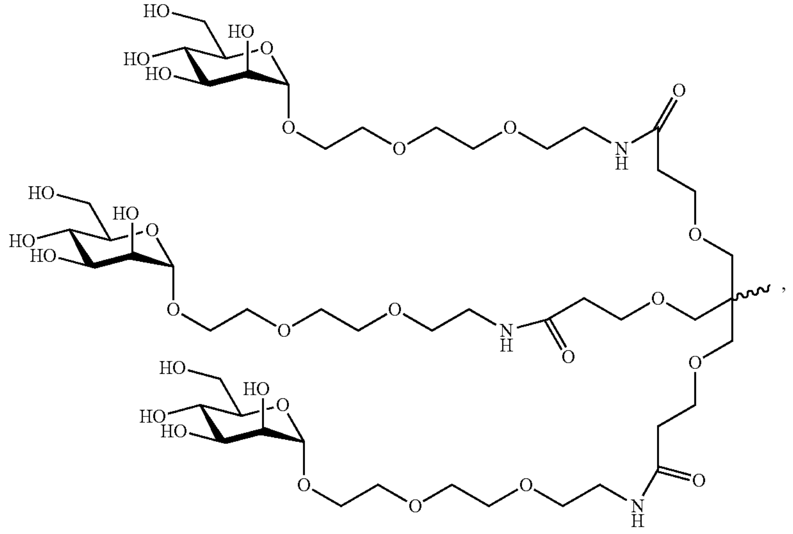
Formula IV
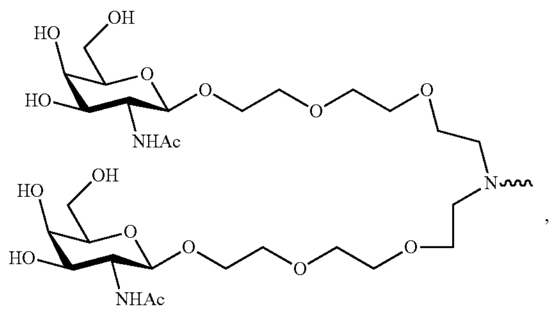
Formula V
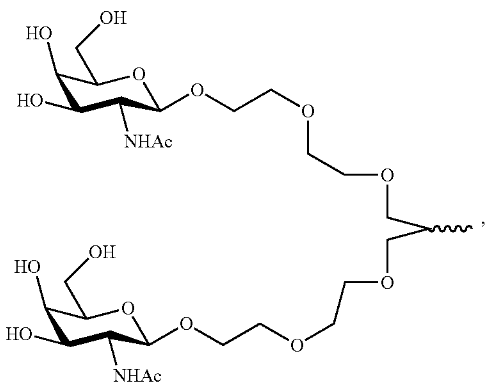

-continued
Formula VI
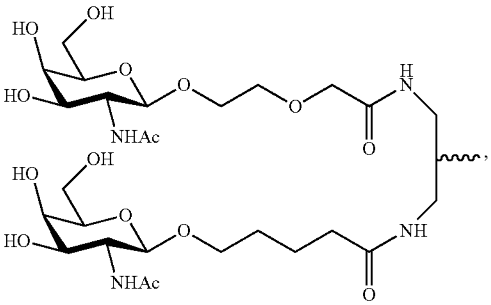
,
Formula VII
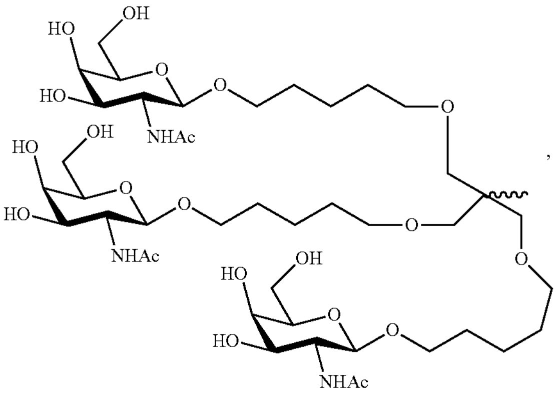
,
Formula VIII
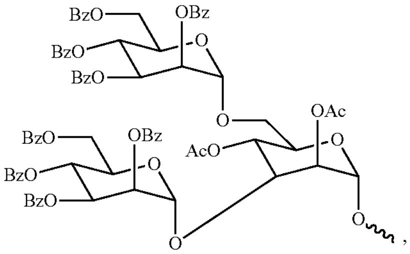
,
Formula IX
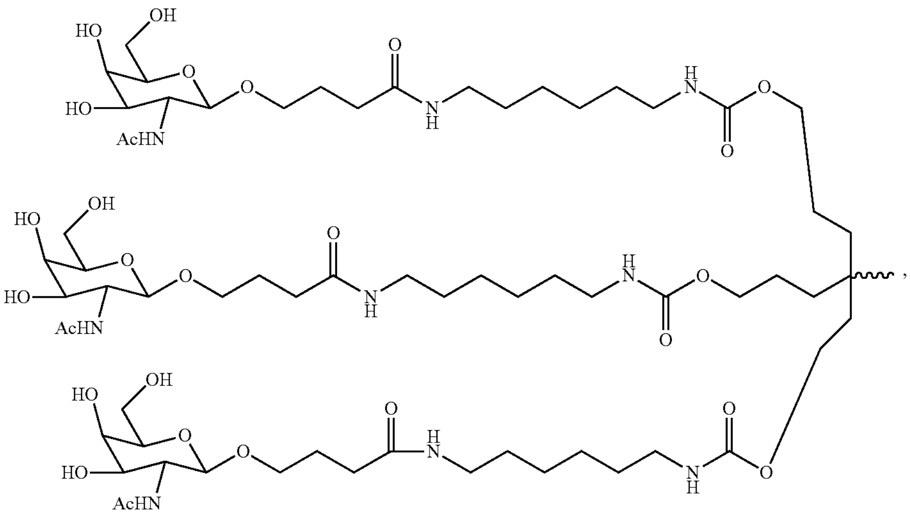
, -continued
Formula X
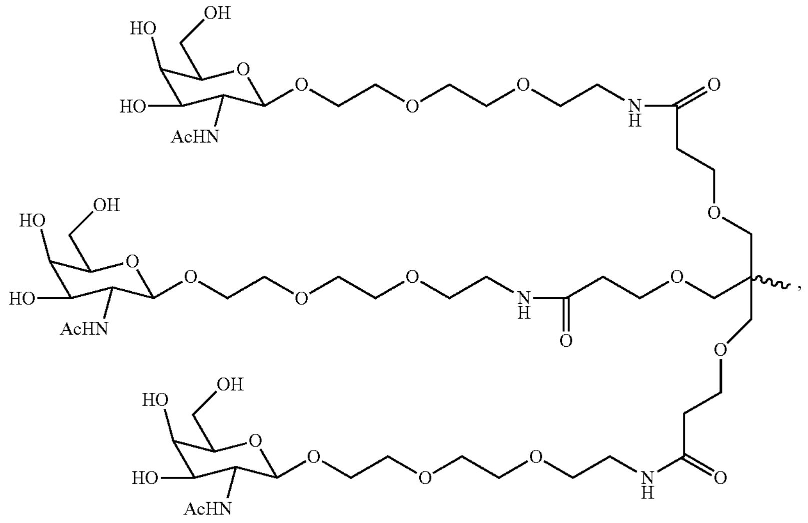
Formula XI
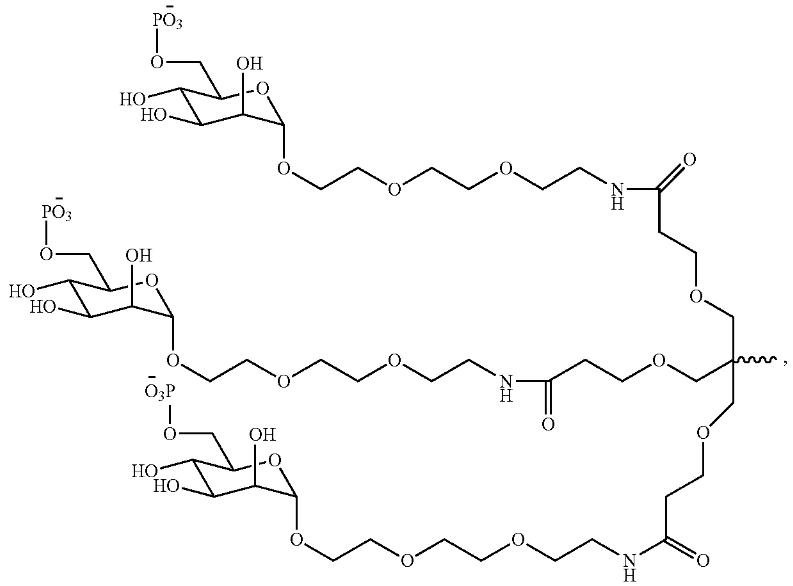

-continued
Formula XII
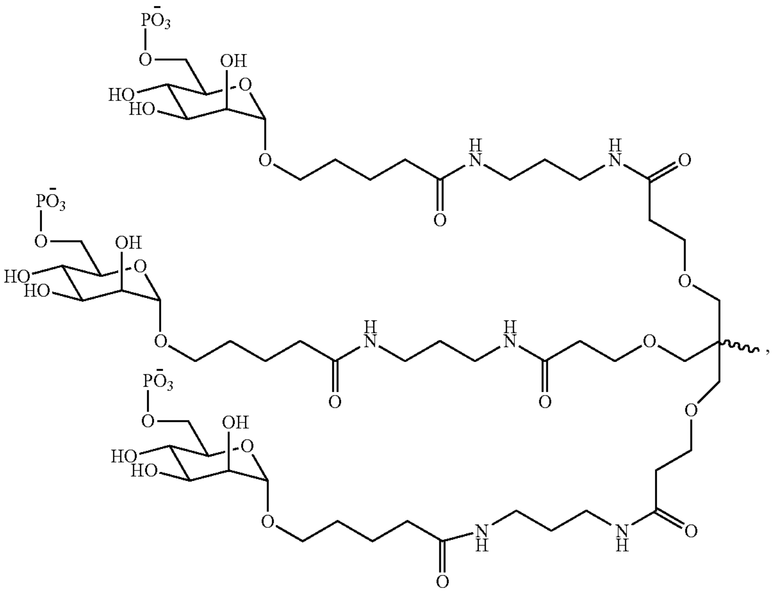
Formula XIII
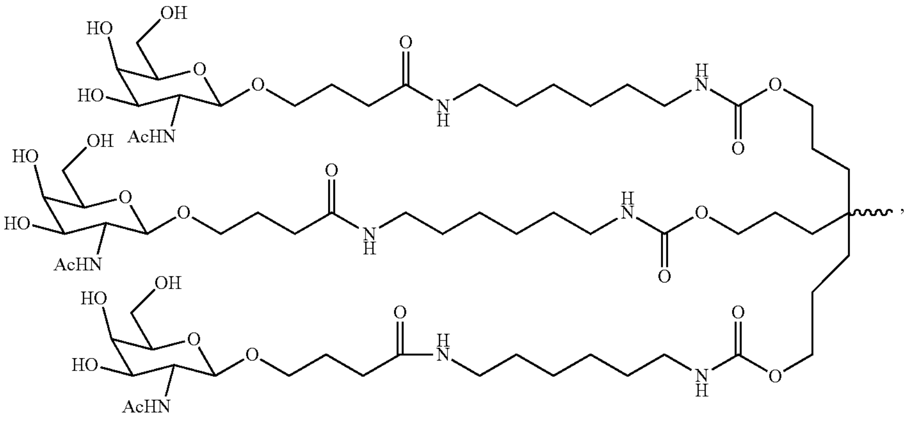
Formula XIV
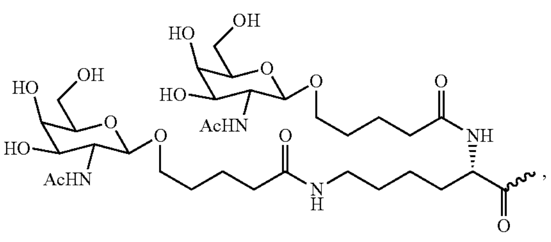
Formula XV
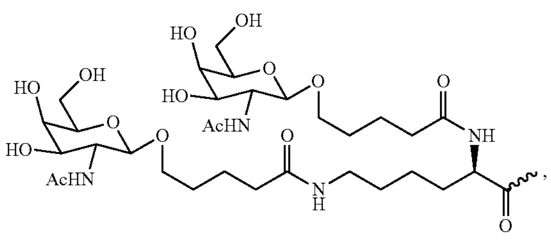
Formula XVI
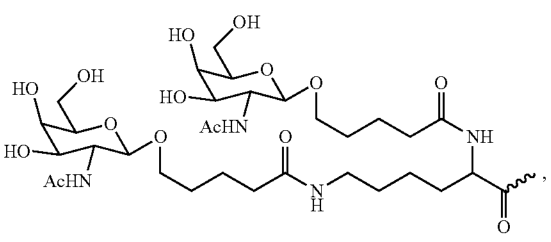
Formula XVII
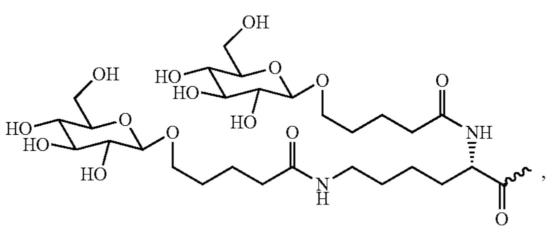

-continued
Formula XVIII
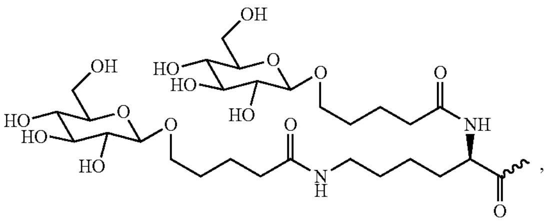
Formula XIX
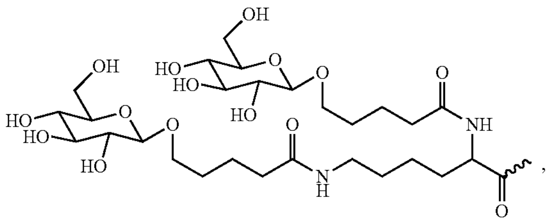
Formula XX
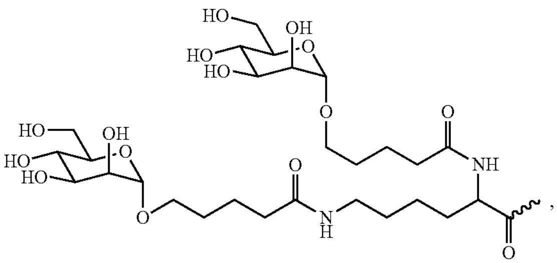
Formula XXI
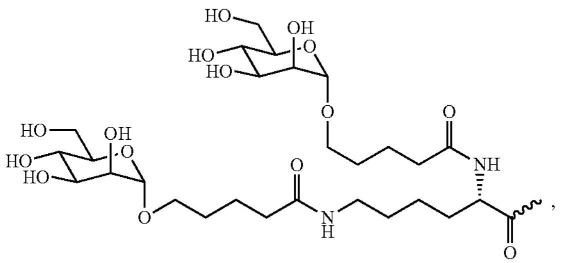
Formula XXII
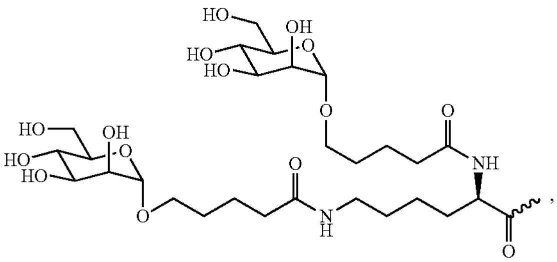
Formula XXIII
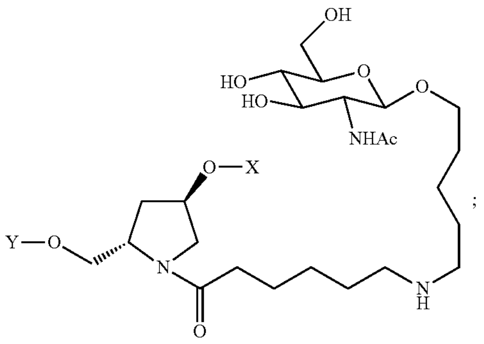
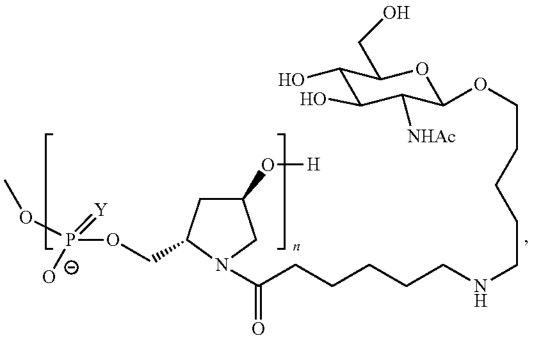

wherein Y is O or S and n is 3-6 (Formula XXIV);
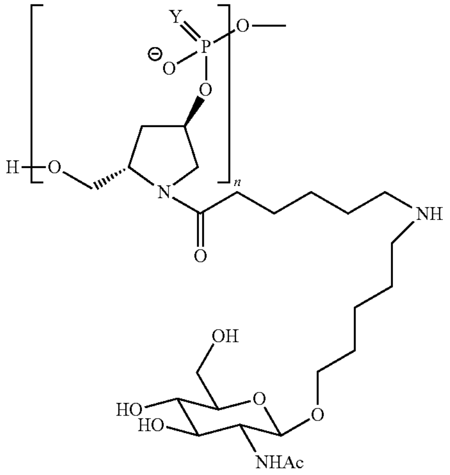
,
wherein Y is O or S and n is 3-6 (Formula XXV);
Formula XXVI
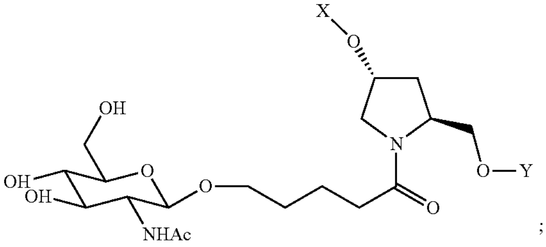
;
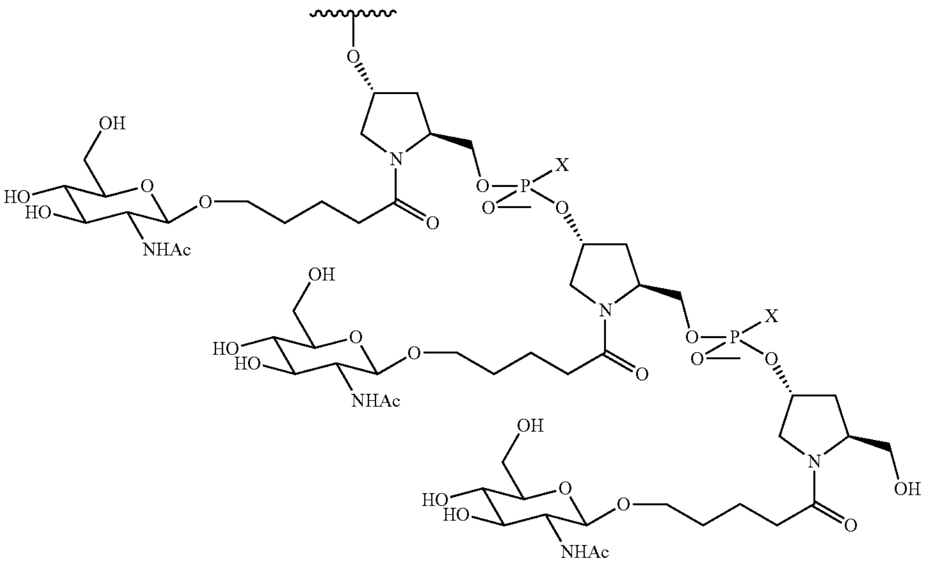

wherein X is O or S (Formula XXVII);
Formula XXVII
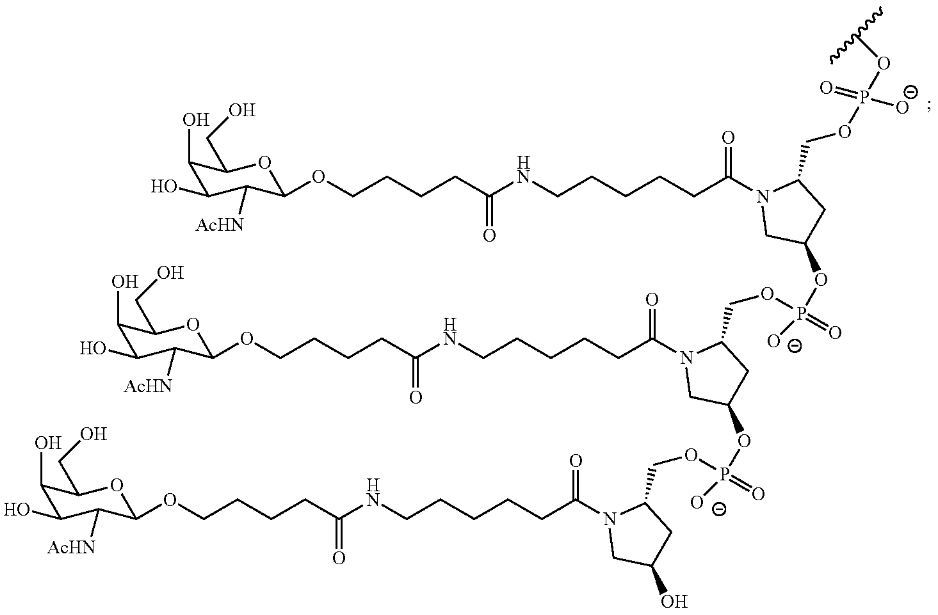
Formula XXIX
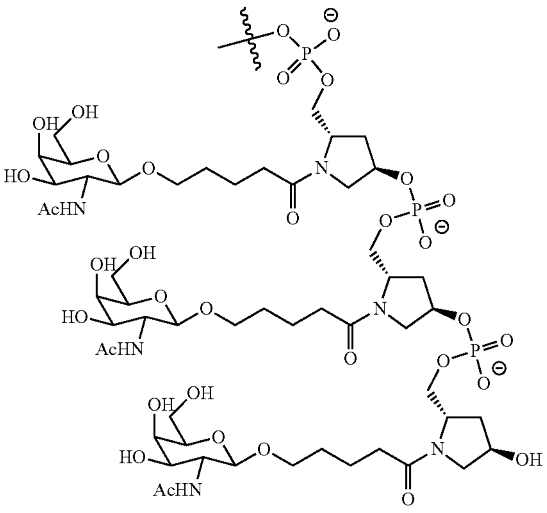
Formula XXX
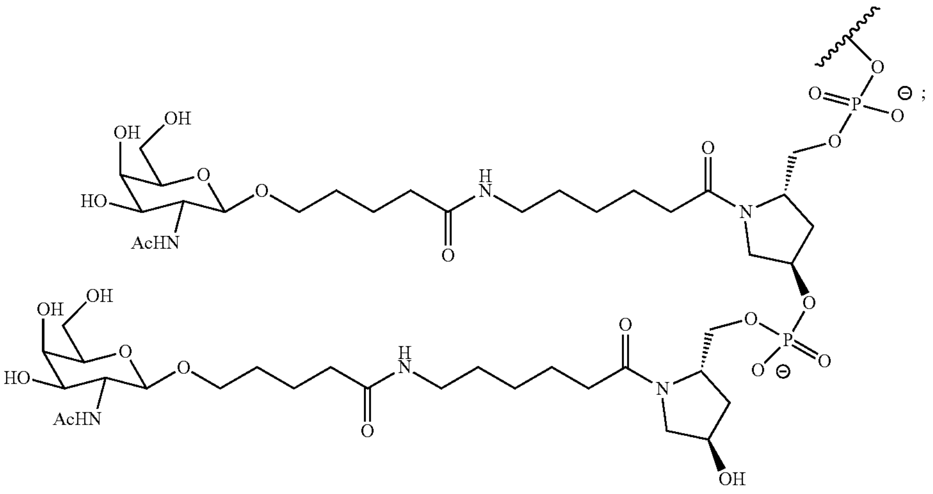

-continued
Formula XXXI
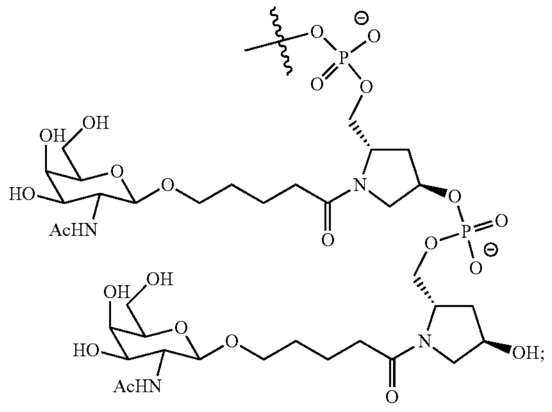
Formula XXXII
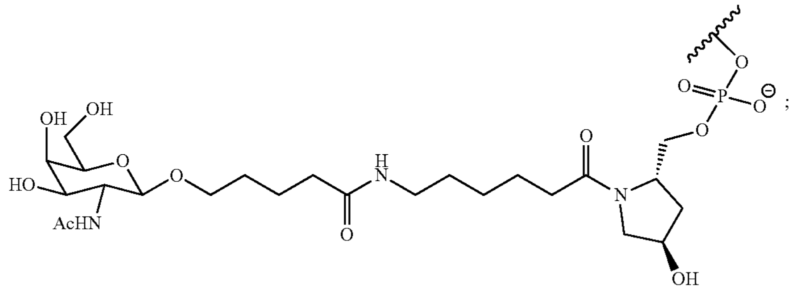
Formula XXXIII
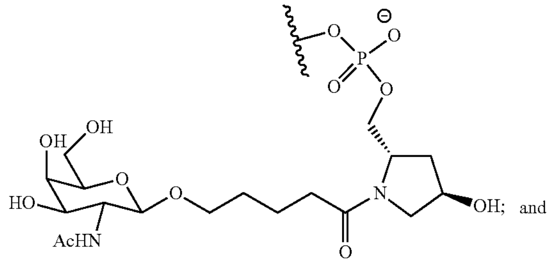
and
Formula XXXIV
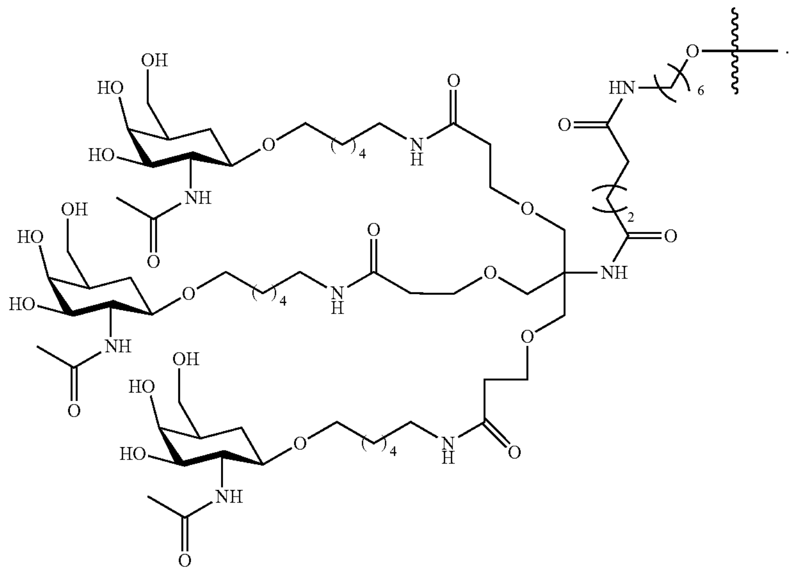

In certain embodiments, a carbohydrate conjugate for use in the compositions and methods of the invention is a monosaccharide. In certain embodiments, the monosaccharide is an N-acetylgalactosamine, such as
Formula II
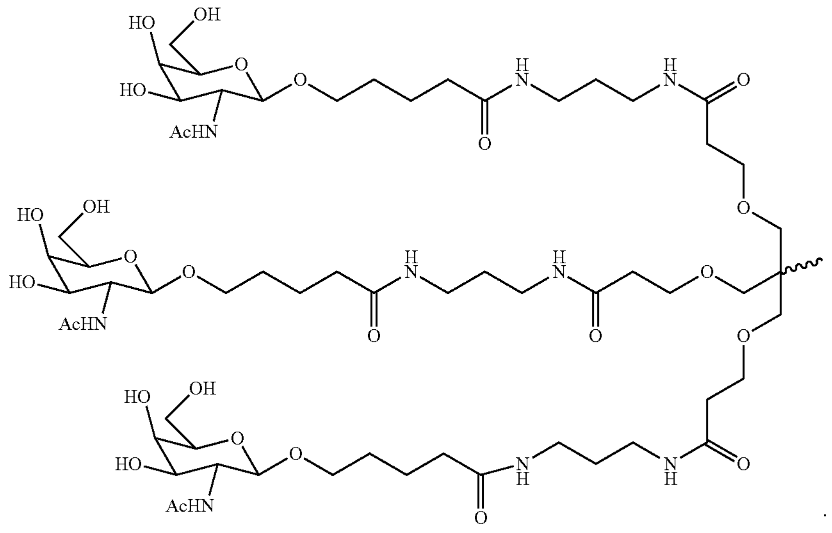
Another representative carbohydrate conjugate for use in the embodiments described herein includes, but is not limited to,

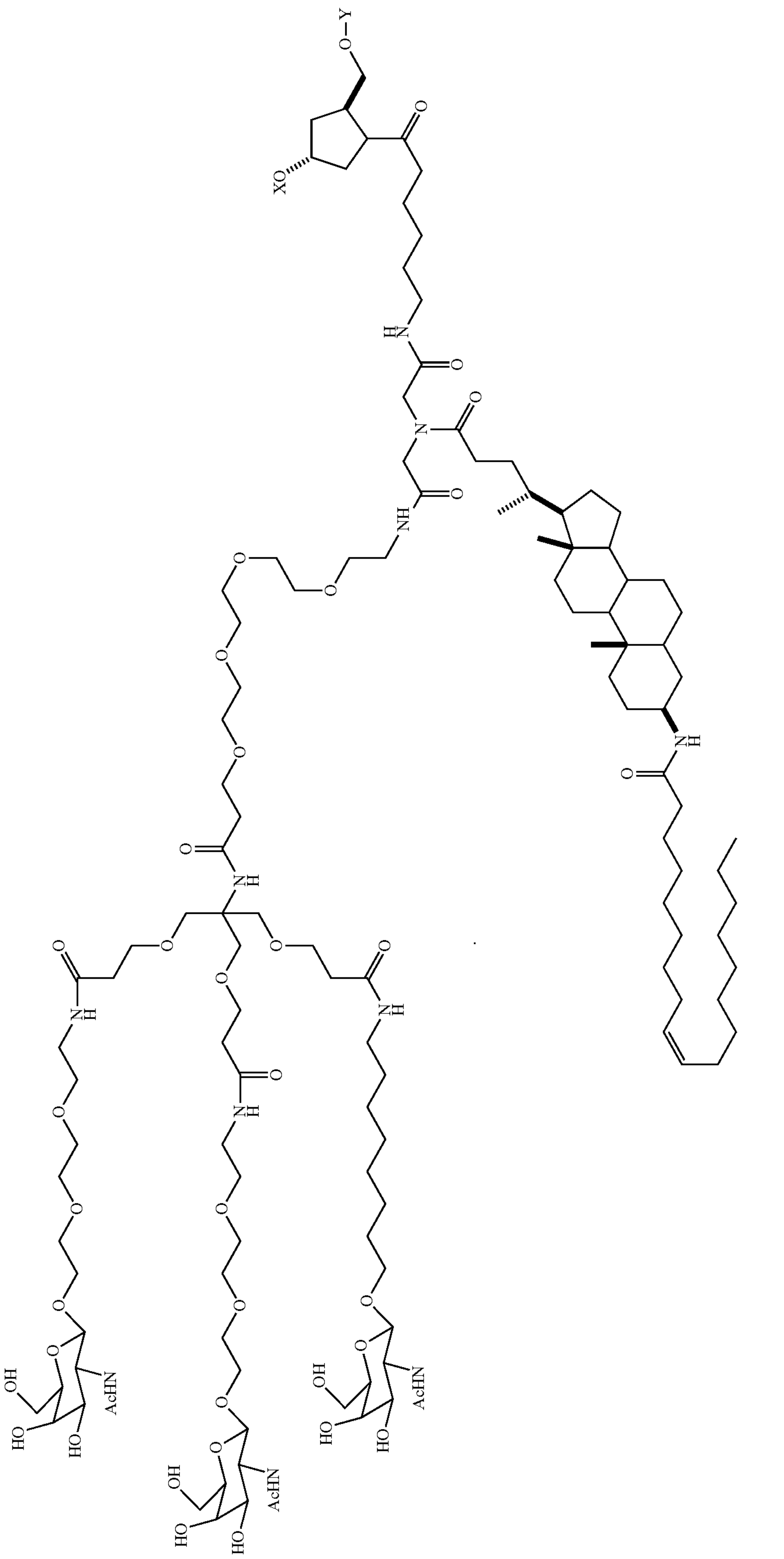

when one of X or Y is an oligonucleotide, the other is a hydrogen.

In some embodiments, a suitable ligand is a ligand disclosed in WO 2019/055633, the entire contents of which are incorporated herein by reference. In one embodiment the ligand comprises the structure below:

Formula XXXVI

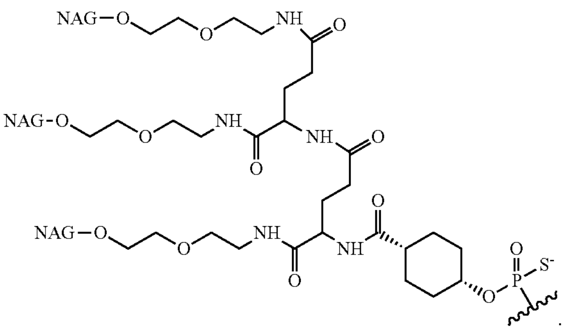

(NAG37)s

In certain embodiments, the RNAi agents of the disclosure may include GalNAc ligands, even if such GalNAc ligands are currently projected to be of limited value for the preferred intrathecal/CNS delivery route(s) of the instant disclosure.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In one embodiment, the double stranded RNAi agents of the invention comprise one or more GalNAc or GalNAc derivative attached to the iRNA agent. The GalNAc may be attached to any nucleotide via a linker on the sense strand or antisense strand. The GalNac may be attached to the 5'-end of the sense strand, the 3' end of the sense strand, the 5'-end of the antisense strand, or the 3'-end of the antisense strand. In one embodiment, the GalNAc is attached to the 3' end of the sense strand, e.g., via a trivalent linker.

In other embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of linkers, e.g., monovalent linkers.

In some embodiments, for example, when the two strands of an iRNA agent of the invention is part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker.

In some embodiments, the carbohydrate conjugate further comprises one or more additional ligands as described above, such as, but not limited to, a PK modulator or a cell permeation peptide.

Additional carbohydrate conjugates and linkers suitable for use in the present invention include those described in WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2NH$ or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In certain embodiments, the linker is between about 1-24 atoms, 2-24, 3-24, 4-24, 5-24, 6-24, 6-18, 7-18, 8-18 atoms, 7-17, 8-17, 6-16, 7-16, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

i. Redox Cleavable Linking Groups

In certain embodiments, a cleavable linking group is a redox cleavable linking group that is cleaved upon reduction or oxidation. An example of reductively cleavable linking group is a disulphide linking group (—S—S—). To determine if a candidate cleavable linking group is a suitable “reductively cleavable linking group,” or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In certain embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, —O—P(S)(H)—S—. A preferred embodiment is —O—P(O)(OH)—O—. These candidates can be evaluated using methods analogous to those described above.

iii. Acid Cleavable Linking Groups

In certain embodiments, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Cleavable Linking Groups

In certain embodiments, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

v. Peptide-Based Cleavable Linking Groups

In yet another embodiment, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O) NHCHRBC(O)—, where RA and RB are the R groups of the two adjacent amino acids. These candidates can be evaluated using methods analogous to those described above.

In some embodiments, an iRNA of the invention is conjugated to a carbohydrate through a linker. Non-limiting examples of iRNA carbohydrate conjugates with linkers of the compositions and methods of the invention include, but are not limited to, Formula XXXVII

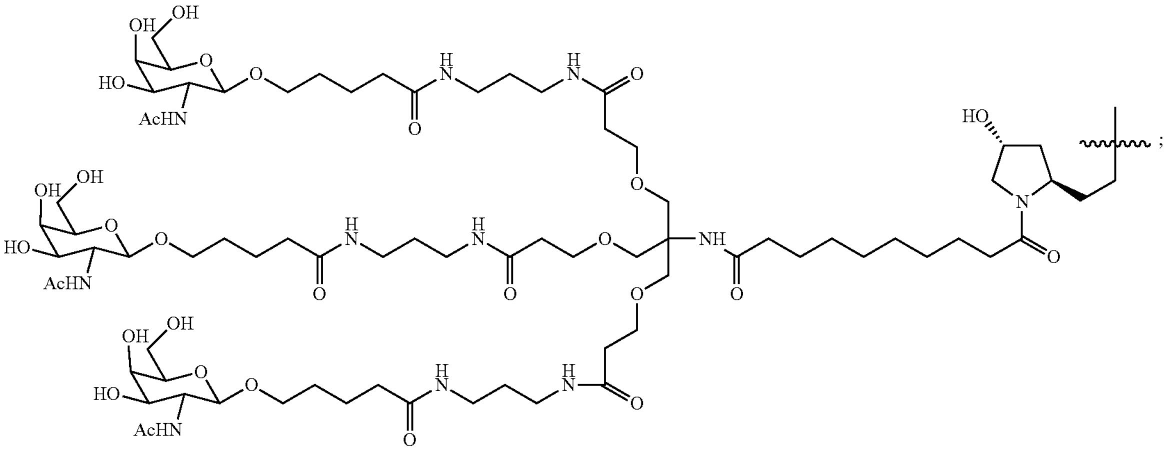

Formula XXXVIII

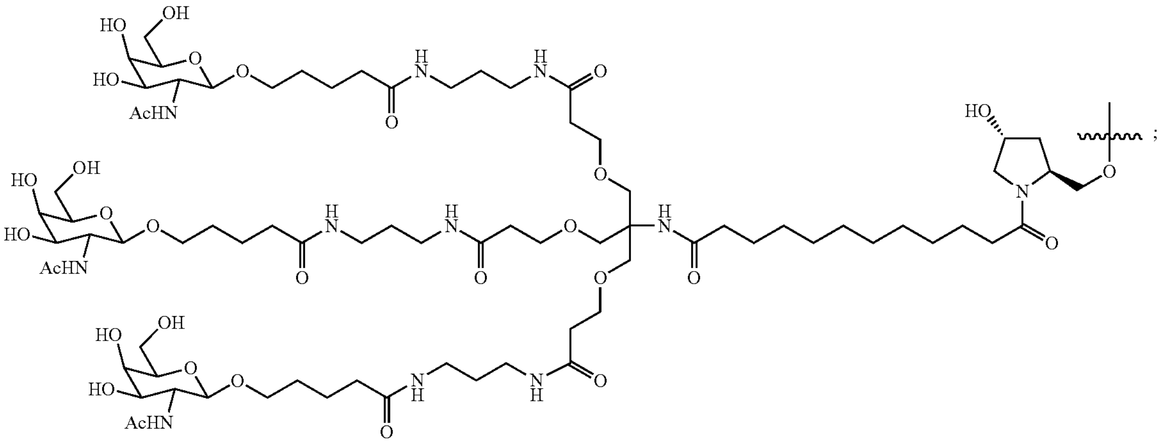

Formula XXXIX

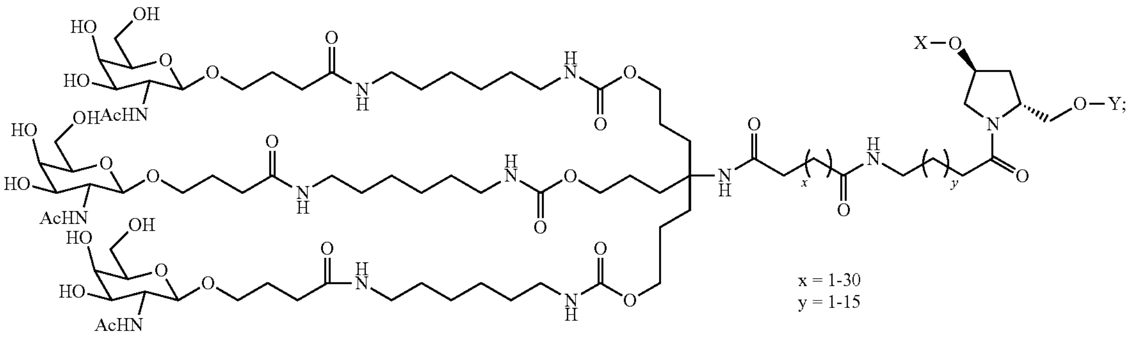

x = 1-30
y = 1-15

-continued
Formula XL
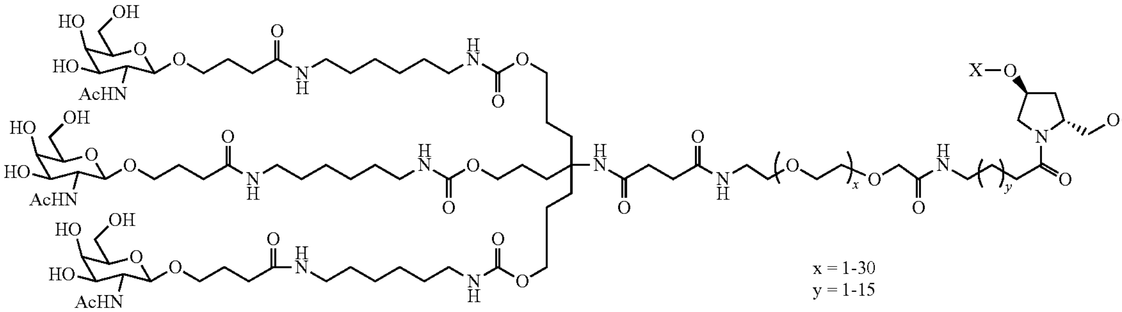
x = 1-30
y = 1-15
Formula XLI
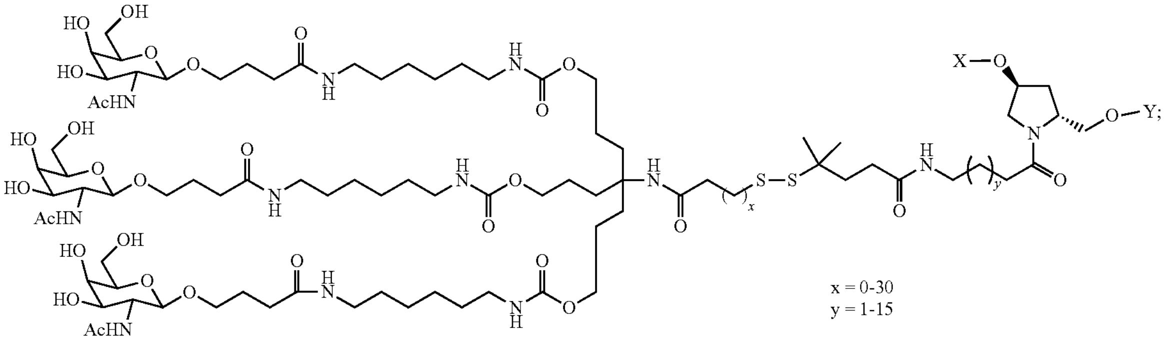
x = 0-30
y = 1-15
Formula XLII
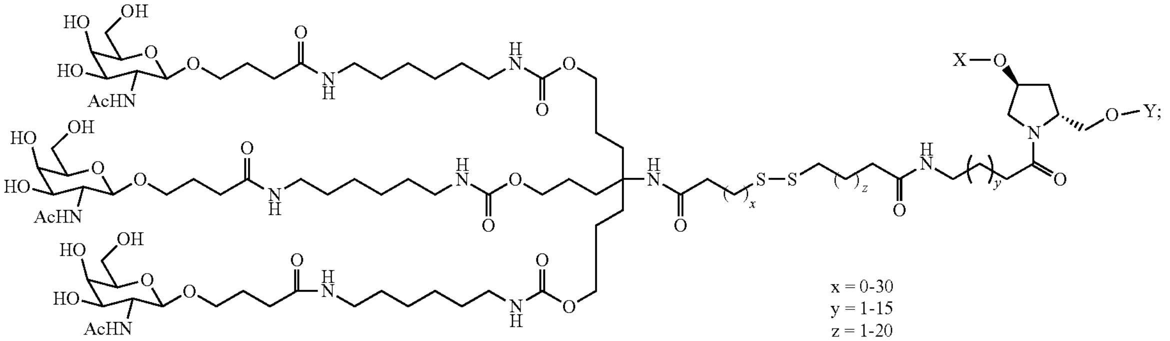
x = 0-30
y = 1-15
z = 1-20
Formula XLIII
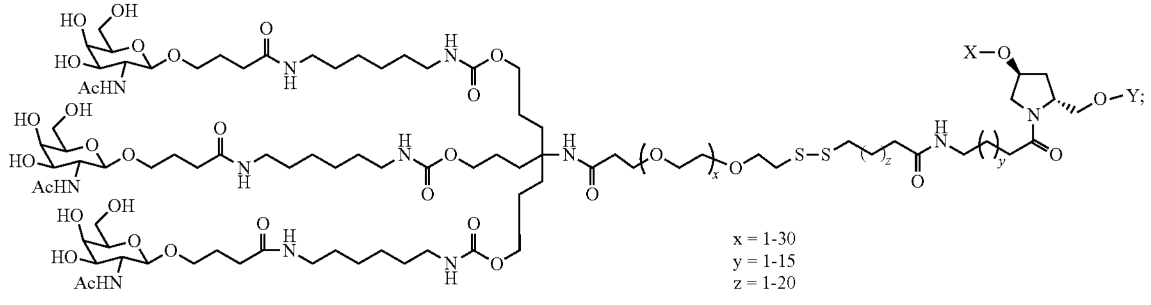
and
x = 1-30
y = 1-15
z = 1-20

-continued

Formula XLIV

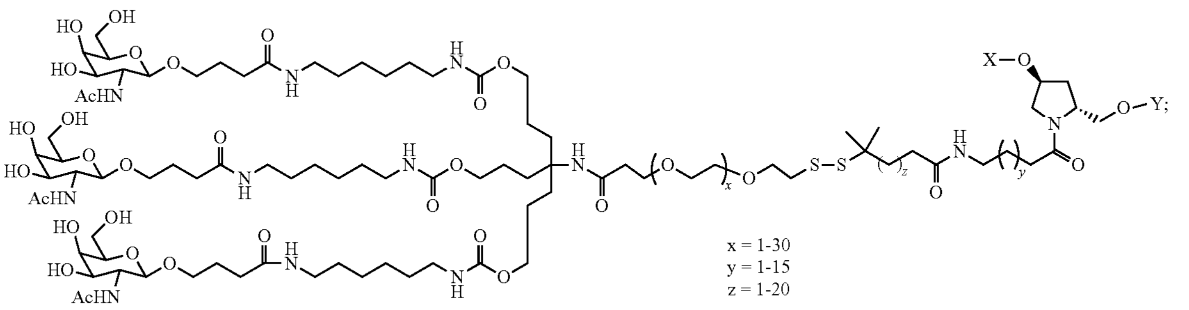

x = 1-30
y = 1-15
z = 1-20 when one of X or Y is an oligonucleotide, the other is a hydrogen.

In certain embodiments of the compositions and methods of the invention, a ligand is one or more "GalNAc" (N-acetylgalactosamine) derivatives attached through a bivalent or trivalent branched linker.

In certain embodiments, a dsRNA of the disclosure is conjugated to a bivalent or trivalent branched linker selected from the group of structures shown in any of formula (XLV)-(XLVIII):

Formula XLV

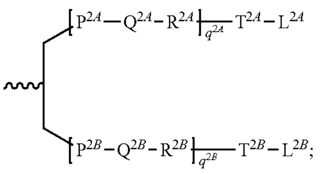

Formula XLVI

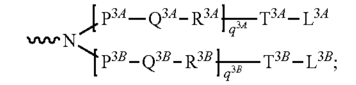

Formula XLVII

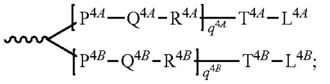

or

Formula XLVIII

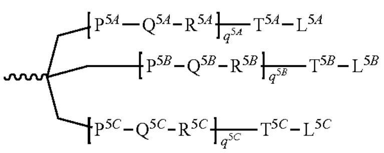

, wherein q2A, q2B, q3A, q3B, q4A, q4B, q5A, q5B and q5C represent independently for each occurrence 0-20 and wherein the repeating unit can be the same or different;

$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), $CH_2$, $CH_2NH$ or $CH_2O$;

$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, $N(R^N)$, C(R')=C(R"), C≡C or C(O);

$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, $CH_2$, C(O)O, C(O)NH, $NHCH(R^a)C(O)$, $—C(O)—CH(R^a)—NH—$, CO, CH=N—O,

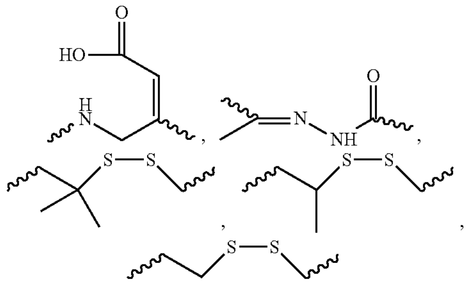

or heterocyclyl;

$L^{2A}$, $L^{2B}$, $L^{3A}$, $L^{3B}$, $L^{4A}$, $L^{4B}$, $L^5A$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XLIX):

Formula XLVIX

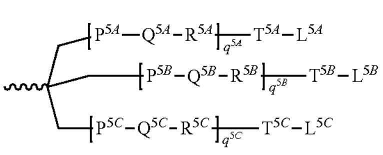

, wherein $L^{5A}$ $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. Patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717, 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112, 963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928; 5,688,941; 6,294,664; 6,320,017; 6,576,752; 6,783,931; 6,900,297; 7,037,646; and 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, preferably dsRNA agents, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.,* 2007, 365(1):54-61; Letsinger et al., *Proc. Natl. Acad. Sci. USA,* 1989, 86:6553), cholic acid (Manoharan et al., *Bioorg. Med. Chem. Lett.,* 1994, 4:1053), a thioether, e.g., hexyl-S-tritylthiol (Manoharan et al., *Ann. N.Y. Acad. Sci.,* 1992, 660:306; Manoharan et al., *Bioorg. Med. Chem. Let.,* 1993, 3:2765), a thiocholesterol (Oberhauser et al., *Nucl. Acids Res.,* 1992, 20:533), an aliphatic chain, e.g., dodecandiol or undecyl residues (Saison-Behmoaras et al., *EMBO J.,* 1991, 10:111; Kabanov et al., *FEBS Lett.,* 1990, 259:327; Svinarchuk et al., *Biochimie,* 1993, 75:49), a phospholipid, e.g., di-hexadecyl-rac-glycerol or triethylammonium 1,2-di-0-hexadecyl-rac-glycero-3-H-phosphonate (Manoharan et al., *Tetrahedron Lett.,* 1995, 36:3651; Shea et al., *Nucl. Acids Res.,* 1990, 18:3777), a polyamine or a polyethylene glycol chain (Manoharan et al., *Nucleosides & Nucleotides,* 1995, 14:969), or adamantane acetic acid (Manoharan et al., *Tetrahedron Lett.,* 1995, 36:3651), a palmityl moiety (Mishra et al., *Biochim. Biophys. Acta,* 1995, 1264:229), or an octadecylamine or hexylamino-carbonyl-oxycholesterol moiety (Crooke et al., *J. Pharmacol. Exp. Ther.,* 1996, 277:923). Representative United States patents that teach the preparation of such RNA conjugates have been listed above. Typical conjugation protocols involve the synthesis of RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

V. Delivery of an RNAi Agent of the Disclosure

The delivery of an RNAi agent of the disclosure to a cell e.g., a cell within a subject, such as a human subject (e.g., a subject in need thereof, such as a subject having a MAPT-associated disorder, for example, Alzheimer's disease, FTD, PSP, or another tauopathy), can be achieved in a number of different ways. For example, delivery may be performed by contacting a cell with an RNAi agent of the disclosure either in vitro or in vivo. In vivo delivery may also be performed directly by administering a composition comprising an RNAi agent, e.g., a dsRNA, to a subject. Alternatively, in vivo delivery may be performed indirectly by administering one or more vectors that encode and direct the expression of the RNAi agent. These alternatives are discussed further below.

In general, any method of delivering a nucleic acid molecule (in vitro or in vivo) can be adapted for use with an RNAi agent of the disclosure (see e.g., Akhtar S. and Julian R L., (1992) Trends *Cell. Biol.* 2(5):139-144 and WO94/02595, which are incorporated herein by reference in their entireties). For in vivo delivery, factors to consider in order to deliver an RNAi agent include, for example, biological stability of the delivered agent, prevention of non-specific effects, and accumulation of the delivered agent in the target tissue. The non-specific effects of an RNAi agent can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the RNAi agent to be administered. Several studies have shown successful knockdown of gene products when an RNAi agent is administered locally. For example, intraocular delivery of a VEGF dsRNA by intravitreal injection in cynomolgus monkeys (Tolentino, M J. et al., (2004) *Retina* 24:132-138) and subretinal injections in mice (Reich, S J. et al. (2003) *Mol. Vis.* 9:210-216) were both shown to prevent neovascularization in an experimental model of age-related macular degeneration. In addition, direct intratumoral injection of a dsRNA in mice reduces tumor volume (Pille, J. et al. (2005) *Mol. Ther.* 11:267-274) and can prolong survival of tumor-bearing mice (Kim, W J. et al., (2006) *Mol. Ther.* 14:343-350; Li, S. et al., (2007) *Mol. Ther.* 15:515-523). RNA interference has also shown success with local delivery to the CNS by direct injection (Dom, G. et al., (2004) *Nucleic Acids* 32:e49; Tan, P H. et al. (2005) *Gene Ther.* 12:59-66; Makimura, H. et al (2002) *BMC Neurosci.* 3:18; Shishkina, G T., et al. (2004) *Neuroscience* 129:521-528; Thakker, E R., et al. (2004) *Proc. Natl. Acad. Sci. U.S.A.* 101:17270-17275; Akaneya, Y., et al. (2005) *J. Neurophysiol.* 93:594-602) and to the lungs by intranasal administration (Howard, K A. et al., (2006) *Mol. Ther.* 14:476-484; Zhang, X. et al., (2004) *J. Biol. Chem.* 279:10677-10684; Bitko, V. et al., (2005) *Nat. Med.* 11:50-55). For administering an RNAi agent systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the RNAi agent to the target tissue and avoid undesirable off-target effects (e.g., without wishing to be bound by theory, use of GNAs as described herein has been identified to destabilize the seed region of a dsRNA, resulting in enhanced preference of such dsRNAs for on-target effectiveness, relative to off-target effects, as such off-target effects are significantly weakened by such seed region destabilization). RNAi agents can be modified by chemical conjugation to lipophilic groups such as cholesterol to enhance cellular uptake and prevent degradation. For example, an RNAi agent directed against ApoB conjugated to a lipophilic cholesterol moiety was injected systemically into mice and resulted in knockdown of apoB mRNA in both the liver and jejunum (Soutschek, J. et al., (2004) *Nature* 432:173-178). Conjugation of an RNAi agent to an aptamer has been shown to inhibit tumor growth and mediate tumor regression in a mouse model of prostate cancer (McNamara, J O. et al., (2006) *Nat. Biotechnol.* 24:1005-1015). In an alternative embodiment, the RNAi agent can be delivered using drug delivery systems such as a nanoparticle, a dendrimer, a polymer, liposomes, or a cationic delivery system. Positively charged cationic delivery systems facilitate binding of molecule RNAi agent (negatively charged) and also enhance interactions at the negatively charged cell membrane to permit efficient uptake of an RNAi agent by the cell. Cationic lipids, dendrimers, or polymers can either be bound to an RNAi agent, or induced to form a vesicle or micelle (see e.g., Kim S H. et al., (2008) *Journal of Controlled Release* 129(2):107-116) that encases an RNAi agent. The formation of vesicles or micelles further prevents degradation of the RNAi agent when administered systemically. Methods for making and administering cationic-RNAi agent complexes are well within the abilities of one skilled in the art (see e.g., Sorensen, D R., et al. (2003) *J. Mol. Biol* 327:761-766; Verma, U N. et al., (2003) *Clin. Cancer Res.* 9:1291-1300; Arnold, A S et al. (2007) *J. Hypertens.* 25:197-205, which are incorporated herein by reference in their entirety). Some non-limiting examples of drug delivery systems useful for systemic delivery of RNAi agents include DOTAP (Sorensen, D R., et al (2003), supra; Verma, U N. et al., (2003), supra), Oligofectamine, "solid nucleic acid lipid particles" (Zimmermann, T S. et al., (2006) *Nature* 441:111-114), cardiolipin (Chien, P Y. et al., (2005) *Cancer Gene Ther.* 12:321-328; Pal, A. et al., (2005) *Int J. Oncol.* 26:1087-1091), polyethyleneimine (Bonnet M E. et al., (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A. et al., (2007) *Biochem. Soc. Trans.* 35:61-67; Yoo, H. et al., (1999) *Pharm. Res.* 16:1799-1804). In some embodiments, an RNAi agent forms a complex with cyclodextrin for systemic administration. Methods for administration and pharmaceutical compositions of RNAi agents and cyclodextrins can be found in U.S. Pat. No. 7,427,605, which is herein incorporated by reference in its entirety.

Certain aspects of the instant disclosure relate to a method of reducing the expression of a MAPT target gene in a cell, comprising contacting said cell with the double-stranded RNAi agent of the disclosure. In one embodiment, the cell is an extraheptic cell, optionally a CNS cell. In another embodiment, the cell is a heptic cell.

Another aspect of the disclosure relates to a method of reducing the expression of a MAPT target gene in a subject, comprising administering to the subject the double-stranded RNAi agent of the disclosure.

Another aspect of the disclosure relates to a method of treating a subject having a CNS disorder (neurodegenerative disorder), comprising administering to the subject a therapeutically effective amount of the double-stranded MAPT-targeting RNAi agent of the disclosure, thereby treating the subject. The neurodegenerative disorder of the subject is associated with an abnormality of MAPT gene encoded protein Tau. The abnormality of MAPT gene encoded protein Tau may result in aggregation of Tau in subject's brain.

Exemplary CNS disorders that can be treated by the method of the disclosure include MAPT-associated disease CNS disorder such as tauopathy, Alzheimer disease, frontotemporal dementia (FTD), behavioral variant frontotemporal dementia (bvFTD), nonfluent variant primary progressive aphasia (nfvPPA), primary progressive aphasia-semantic (PPA-S), primary progressive aphasia-logopenic (PPA-L), frontotemporal dementia with parkinsonism linked to chromosome 17 (FTDP-17), Pick's disease (PiD), argyrophilic grain disease (AGD), multiple system tauopathy with presenile dementia (MSTD), white matter tauopathy with globular glial inclusions (FTLD with GGIs), FTLD with MAPT mutations, neurofibrillary tangle (NFT) dementia, FTD with motor neuron disease, amyotrophic lateral sclerosis (ALS), corticobasal syndrome (CBS), corticobasal degeneration (CBD), progressive supranuclear palsy (PSP), Parkinson's disease, postencephalitic Parkinsonism, Niemann-Pick disease, Huntington disease, type 1 myotonic dystrophy, and Down syndrome (DS).

In one embodiment, the double-stranded RNAi agent is administered intrathecally. By intrathecal administration of the double-stranded RNAi agent, the method can reduce the expression of a MAPT target gene in a brain (e.g., striatum) or spine tissue, for instance, cortex, cerebellum, cervical spine, lumbar spine, and thoracic spine, immune cells such as monocytes and T-cells.

For ease of exposition the formulations, compositions and methods in this section are discussed largely with regard to modified siRNA compounds. It may be understood, however, that these formulations, compositions and methods can be practiced with other siRNA compounds, e.g., unmodified siRNA compounds, and such practice is within the disclosure. A composition that includes an RNAi agent can be delivered to a subject by a variety of routes. Exemplary routes include: intrathecal, intravenous, topical, rectal, anal, vaginal, nasal, pulmonary, and ocular.

The RNAi agents of the disclosure can be incorporated into pharmaceutical compositions suitable for administration. Such compositions typically include one or more species of RNAi agent and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The pharmaceutical compositions of the present disclosure may be administered in a number of ways depending upon whether local or systemic treatment is desired and upon the area to be treated. Administration may be topical (including ophthalmic, vaginal, rectal, intranasal, transdermal), intrathecal, oral, or parenteral. Parenteral administration includes intravenous drip, subcutaneous, intraperitoneal or intramuscular injection, or intrathecal or intraventricular administration.

The route and site of administration may be chosen to enhance targeting. For example, to target neural or spinal tissue, intrathecal injection would be a logical choice. Lung cells might be targeted by administering the RNAi agent in aerosol form. The vascular endothelial cells could be targeted by coating a balloon catheter with the RNAi agent and mechanically introducing the RNA.

Formulations for topical administration may include transdermal patches, ointments, lotions, creams, gels, drops, suppositories, sprays, liquids, and powders. Conventional pharmaceutical carriers, aqueous, powder or oily bases, thickeners and the like may be necessary or desirable. Coated condoms, gloves and the like may also be useful.

Compositions for oral administration include powders or granules, suspensions or solutions in water, syrups, elixirs or non-aqueous media, tablets, capsules, lozenges, or troches. In the case of tablets, carriers that can be used include lactose, sodium citrate and salts of phosphoric acid. Various disintegrants such as starch, and lubricating agents such as magnesium stearate, sodium lauryl sulfate and talc, are commonly used in tablets. For oral administration in capsule form, useful diluents are lactose and high molecular weight polyethylene glycols. When aqueous suspensions are required for oral use, the nucleic acid compositions can be combined with emulsifying and suspending agents. If desired, certain sweetening or flavoring agents can be added.

Compositions for intrathecal or intraventricular administration may include sterile aqueous solutions which may also contain buffers, diluents, and other suitable additives.

Formulations for parenteral administration may include sterile aqueous solutions which may also contain buffers, diluents, and other suitable additives. Intraventricular injection may be facilitated by an intraventricular catheter, for example, attached to a reservoir. For intravenous use, the total concentration of solutes may be controlled to render the preparation isotonic.

In one embodiment, the administration of the siRNA compound, e.g., a double-stranded siRNA compound, or ssiRNA compound, administration of the composition is parenteral, e.g., intravenous (e.g., as a bolus or as a diffusible infusion), intradermal, intraperitoneal, intramuscular, intrathecal, intraventricular, intracranial, subcutaneous, transmucosal, buccal, sublingual, endoscopic, rectal, oral, vaginal, topical, pulmonary, intranasal, urethral, or ocular. Administration can be provided by the subject or by another person, e.g., a health care provider. The medication can be provided in measured doses or in a dispenser which delivers a metered dose. Selected modes of delivery are discussed in more detail below.

A. Intrathecal Administration.

In one embodiment, the double-stranded RNAi agent is delivered by intrathecal injection (i.e., injection into the spinal fluid which bathes the brain and spinal cord tissue). Intrathecal injection of RNAi agents into the spinal fluid can be performed as a bolus injection or via minipumps which can be implanted beneath the skin, providing a regular and constant delivery of siRNA into the spinal fluid. The circulation of the spinal fluid from the choroid plexus, where it is produced, down around the spinal chord and dorsal root ganglia and subsequently up past the cerebellum and over the cortex to the arachnoid granulations, where the fluid can exit the CNS, that, depending upon size, stability, and solubility of the compounds injected, molecules delivered intrathecally could hit targets throughout the entire CNS.

In some embodiments, the intrathecal administration is via a pump. The pump may be a surgically implanted osmotic pump. In one embodiment, the osmotic pump is implanted into the subarachnoid space of the spinal canal to facilitate intrathecal administration.

In some embodiments, the intrathecal administration is via an intrathecal delivery system for a pharmaceutical including a reservoir containing a volume of the pharmaceutical agent, and a pump configured to deliver a portion of the pharmaceutical agent contained in the reservoir. More details about this intrathecal delivery system may be found in WO 2015/116658, which is incorporated by reference in its entirety.

The amount of intrathecally injected RNAi agents may vary from one target gene to another target gene and the appropriate amount that has to be applied may have to be determined individually for each target gene. Typically, this amount ranges from 10 μg to 2 mg, preferably 50 μg to 1500 μg, more preferably 100 μg to 1000 μg.

B. Vector Encoded RNAi Agents of the Disclosure

RNAi agents targeting the MAPT gene can be expressed from transcription units inserted into DNA or RNA vectors (see, e.g., Couture, A, et al., *TIG*. (1996), 12:5-10; WO 00/22113, WO 00/22114, and U.S. Pat. No. 6,054,299). Expression is preferably sustained (months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., (1995) *Proc. Natl. Acad. Sci. USA* 92:1292).

The individual strand or strands of an RNAi agent can be transcribed from a promoter on an expression vector. Where two separate strands are to be expressed to generate, for example, a dsRNA, two separate expression vectors can be co-introduced (e.g., by transfection or infection) into a target cell. Alternatively, each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

RNAi agent expression vectors are generally DNA plasmids or viral vectors. Expression vectors compatible with eukaryotic cells, preferably those compatible with vertebrate cells, can be used to produce recombinant constructs for the expression of an RNAi agent as described herein. Delivery of RNAi agent expressing vectors can be systemic, such as by intravenous or intramuscular administration, by administration to target cells ex-planted from the patient followed by reintroduction into the patient, or by any other means that allows for introduction into a desired target cell.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an RNAi agent will generally require regulatory elements, e.g., promoters, enhancers, etc., to ensure the expression of the RNAi agent in target cells. Other aspects to consider for vectors and constructs are known in the art.

VI. Pharmaceutical Compositions of the Invention

The present disclosure also includes pharmaceutical compositions and formulations which include the RNAi agents of the disclosure. In one embodiment, provided herein are pharmaceutical compositions containing an RNAi agent, as described herein, and a pharmaceutically acceptable carrier. The pharmaceutical compositions containing the RNAi agent are useful for treating a disease or disorder associated with the expression or activity of MAPT, e.g., MAPT-associated disease.

In some embodiments, the pharmaceutical composition of the invention is the dsRNA agent for selective inhibition of exon 10-containing MAPT transcripts.

In some embodiments, the pharmaceutical compositions of the invention are sterile. In another embodiment, the pharmaceutical compositions of the invention are pyrogen free.

Such pharmaceutical compositions are formulated based on the mode of delivery. One example is compositions that are formulated for systemic administration via parenteral delivery, e.g., by intravenous (IV), intramuscular (IM), or for subcutaneous (subQ) delivery. Another example is compositions that are formulated for direct delivery into the CNS, e.g., by intrathecal or intravitreal routes of injection, optionally by infusion into the brain (e.g., striatum), such as by continuous pump infusion.

The pharmaceutical compositions of the disclosure may be administered in dosages sufficient to inhibit expression of a MAPT gene. In general, a suitable dose of an RNAi agent of the disclosure will be in the range of about 0.001 to about 200.0 milligrams per kilogram body weight of the recipient per day, generally in the range of about 1 to 50 mg per kilogram body weight per day.

A repeat-dose regimen may include administration of a therapeutic amount of an RNAi agent on a regular basis, such as monthly to once every six months. In certain embodiments, the RNAi agent is administered about once per quarter (i.e., about once every three months) to about twice per year.

After an initial treatment regimen (e.g., loading dose), the treatments can be administered on a less frequent basis.

In other embodiments, a single dose of the pharmaceutical compositions can be long lasting, such that subsequent doses are administered at not more than 1, 2, 3, or 4 or more month intervals. In some embodiments of the disclosure, a single dose of the pharmaceutical compositions of the disclosure is administered once per month. In other embodiments of the disclosure, a single dose of the pharmaceutical compositions of the disclosure is administered once per quarter to twice per year.

The skilled artisan will appreciate that certain factors can influence the dosage and timing required to effectively treat a subject, including but not limited to the severity of the disease or disorder, previous treatments, the general health or age of the subject, and other diseases present. Moreover, treatment of a subject with a therapeutically effective amount of a composition can include a single treatment or a series of treatments.

Advances in mouse genetics have generated a number of mouse models for the study of various human diseases, such as ALS and FTD that would benefit from reduction in the expression of MAPT. Such models can be used for in vivo testing of RNAi agents, as well as for determining a therapeutically effective dose. Suitable rodent models are known in the art and include, for example, those described in, for example, Cepeda, et al. (*ASN Neuro* (2010) 2(2):e00033) and Pouladi, et al. (*Nat Reviews* (2013) 14:708).

The pharmaceutical compositions of the present disclosure can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The RNAi agents can be delivered in a manner to target a particular tissue, such as the CNS (e.g., neuronal, glial or vascular tissue of the brain).

Pharmaceutical compositions and formulations for topical administration can include transdermal patches, ointments, lotions, creams, gels, drops, suppositories, sprays, liquids and powders. Conventional pharmaceutical carriers, aqueous, powder or oily bases, thickeners and the like can be necessary or desirable. Coated condoms, gloves and the like can also be useful. Suitable topical formulations include those in which the RNAi agents featured in the disclosure are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). RNAi agents featured in the disclosure can be encapsulated within liposomes or can form complexes thereto, in particular to cationic liposomes. Alternatively, RNAi agents can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcamitine, an acylcholine, or a $C_{1-20}$ alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

A. RNAi Agent Formulations Comprising Membranous Molecular Assemblies

An RNAi agent for use in the compositions and methods of the disclosure can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the RNAi agent composition. The lipophilic material isolates the aqueous interior from an aqueous exterior, which typically does not include the RNAi agent composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the RNAi agent are delivered into the cell where the RNAi agent can specifically bind to a target RNA and can mediate RNAi. In some cases, the liposomes are also specifically targeted, e.g., to direct the RNAi agent to particular cell types.

A liposome containing an RNAi agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The RNAi agent preparation is then added to the micelles that include the lipid component. The cationic groups on the lipid interact with the RNAi agent and condense around the RNAi agent to form a liposome. After condensation, the detergent is removed, e.g., by dialysis, to yield a liposomal preparation of RNAi agent.

If necessary a carrier compound that assists in condensation can be added during the condensation reaction, e.g., by controlled addition. For example, the carrier compound can be a polymer other than a nucleic acid (e.g., spermine or spermidine). pH can also be adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Felgner, P. L. et al., (1987) *Proc. Nat. Acad. Sci. USA* 8:7413-7417; U.S. Pat. Nos. 4,897,355; 5,171,678; Bangham et al., (1965) *M Mol. Biol.* 23:238; Olson et al., (1979) *Biochim. Biophys. Acta* 557:9; Szoka et al., (1978) *Proc. Nat. Acad. Sci.* 75: 4194; Mayhew et al., (1984) *Biochim. Biophys. Acta* 775:169; Kim et al., (1983) *Biochim. Biophys. Acta* 728:339; and Fukunaga et al., (1984) *Endocrinol.* 115:757. Commonly used techniques for preparing lipid aggregates of appropriate size for use as delivery vehicles include sonication and freeze-thaw plus extrusion (see, e.g., Mayer et al., (1986) *Biochim. Biophys. Acta* 858:161. Microfluidization can be used when consistently small (50 to 200 nm) and relatively uniform aggregates are desired (Mayhew et al., (1984) *Biochim. Biophys. Acta* 775:169. These methods are readily adapted to packaging RNAi agent preparations into liposomes.

Liposomes fall into two broad classes. Cationic liposomes are positively charged liposomes which interact with the negatively charged nucleic acid molecules to form a stable complex. The positively charged nucleic acid/liposome complex binds to the negatively charged cell surface and is internalized in an endosome. Due to the acidic pH within the endosome, the liposomes are ruptured, releasing their contents into the cell cytoplasm (Wang et al. (1987) *Biochem. Biophys. Res. Commun.,* 147:980-985).

Liposomes, which are pH-sensitive or negatively charged, entrap nucleic acids rather than complex with them. Since both the nucleic acid and the lipid are similarly charged, repulsion rather than complex formation occurs. Nevertheless, some nucleic acid is entrapped within the aqueous interior of these liposomes. pH sensitive liposomes have been used to deliver nucleic acids encoding the thymidine kinase gene to cell monolayers in culture. Expression of the exogenous gene was detected in the target cells (Zhou et al. (1992) *Journal of Controlled Release,* 19:269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid or phosphatidylcholine or cholesterol.

Examples of other methods to introduce liposomes into cells in vitro and in vivo include U.S. Pat. Nos. 5,283,185; 5,171,678; WO 94/00569; WO 93/24640; WO 91/16024; Felgner, (1994) *J. Biol. Chem.* 269:2550; Nabel, (1993) *Proc. Natl. Acad. Sci.* 90:11307; Nabel, (1992) Human *Gene Ther.* 3:649; Gershon, (1993) *Biochem.* 32:7143; and Strauss, (1992) *EMBO J.* 11:417.

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporine A into different layers of the skin (Hu et al., (1994) *S.T.P. Pharma. Sci.,* 4(6):466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., (1987) *FEBS Letters,* 223:42; Wu et al., (1993) *Cancer Research,* 53:3765).

Various liposomes comprising one or more glycolipids are known in the art. Papahadjopoulos et al. (*Ann. N.Y. Acad. Sci.*, (1987), 507:64) reported the ability of monosialoganglioside $G_{M1}$, galactocerebroside sulfate and phosphatidylinositol to improve blood half-lives of liposomes. These findings were expounded upon by Gabizon et al. (*Proc. Natl. Acad. Sci. U.S.A.*, (1988), 85:6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

In one embodiment, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver RNAi agents to macrophages.

Further advantages of liposomes include: liposomes obtained from natural phospholipids are biocompatible and biodegradable; liposomes can incorporate a wide range of water and lipid soluble drugs; liposomes can protect encapsulated RNAi agents in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of RNAi agent (see, e.g., Felgner, P. L. et al., (1987) *Proc. Natl. Acad. Sci. USA* 8:7413-7417, and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Indiana) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wisconsin) and dipalmitoylphosphatidylethanolamine 5-carboxyspermylamide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., (1991) *Biochim. Biophys. Res. Commun.* 179:280). Lipopolylysine, made by conjugating polylysine to DOPE, has been reported to be effective for transfection in the presence of serum (Zhou, X. et al., (1991) *Biochim. Biophys. Acta* 1065:8). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, California) and Lipofectamine (DOSPA) (Life Technology, Inc., Gaithersburg, Maryland). Other cationic lipids suitable for the delivery of oligonucleotides are described in WO 98/39359 and WO 96/37194.

Liposomal formulations are particularly suited for topical administration; liposomes present several advantages over other formulations. Such advantages include reduced side effects related to high systemic absorption of the administered drug, increased accumulation of the administered drug at the desired target, and the ability to administer RNAi agent into the skin. In some implementations, liposomes are used for delivering RNAi agent to epidermal cells and also to enhance the penetration of RNAi agent into dermal tissues, e.g., into skin. For example, the liposomes can be applied topically. Topical delivery of drugs formulated as liposomes to the skin has been documented (see, e.g., Weiner et al., (1992) *Journal of Drug Targeting*, vol. 2,405-410 and du Plessis et al., (1992) *Antiviral Research,* 18:259-265; Mannino, R. J. and Fould-Fogerite, S., (1998) *Biotechniques* 6:682-690; Itani, T. et al., (1987) *Gene* 56:267-276; Nicolau, C. et al. (1987) *Meth. Enzymol.* 149:157-176; Straubinger, R. M. and Papahadjopoulos, D. (1983) *Meth. Enzymol.* 101:512-527; Wang, C. Y. and Huang, L., (1987) *Proc. Natl. Acad. Sci. USA* 84:7851-7855).

Non-ionic liposomal systems have also been examined to determine their utility in the delivery of drugs to the skin, in particular systems comprising non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) were used to deliver a drug into the dermis of mouse skin. Such formulations with RNAi agent are useful for treating a dermatological disorder.

Liposomes that include RNAi agents can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include RNAi agent can be delivered, for example, subcutaneously by infection in order to deliver RNAi agent to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

Other formulations amenable to the present disclosure are described in U.S. provisional application Ser. No. 61/018,616, filed Jan. 2, 2008; 61/018,611, filed Jan. 2, 2008; 61/039,748, filed Mar. 26, 2008; 61/047,087, filed Apr. 22, 2008 and 61/051,528, filed May 8, 2008. PCT application number PCT/US2007/080331, filed Oct. 3, 2007, also describes formulations that are amenable to the present disclosure.

Transfersomes, yet another type of liposomes, are highly deformable lipid aggregates which are attractive candidates for drug delivery vehicles. Transfersomes can be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as those described herein, particularly in emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general, their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

The RNAi agent for use in the methods of the disclosure can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the siRNA composition, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Phenol or m-cresol may be added to the mixed micellar composition to stabilize the formulation and protect against bacterial growth. Alternatively, phenol or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

B. Lipid Particles

RNAi agents, e.g., dsRNAs of in the disclosure may be fully encapsulated in a lipid formulation, e.g., a LNP, or other nucleic acid-lipid particle.

As used herein, the term "LNP" refers to a stable nucleic acid-lipid particle. LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in WO 00/03683. The particles of the present disclosure typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present disclosure are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; United States Patent Publication No. 2010/0324120 and WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the disclosure.

Certain specific LNP formulations for delivery of RNAi agents have been described in the art, including, e.g., "LNP01" formulations as described in, e.g., WO 2008/042973, which is hereby incorporated by reference.

Additional exemplary lipid-dsRNA formulations are identified in the Table 1 below.

TABLE 1

| | Ionizable/Cationic Lipid | cationic lipid/non-cationic lipid/cholesterol/PEG-lipid conjugate Lipid:siRNA ratio |
|---|---|---|
| SNALP-1 | 1,2-Dilinolenyloxy-N,N-dimethylaminopropane (DLinDMA) | DLinDMA/DPPC/Cholesterol/PEG-CDMA (57.1/7.1/34.4/1.4) lipid:siRNA ~ 7:1 |
| 2-XTC | 2,2-Dilinoleyl-4-dimethylaminoethyl-[1,3]-dioxolane (XTC) | XTC/DPPC/Cholesterol/PEG-CDMA 57.1/7.1/34.4/1.4 lipid:siRNA ~ 7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~ 6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~ 11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~ 6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~ 11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1) | Tech G1/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |

TABLE 1-continued

| | Ionizable/Cationic Lipid | cationic lipid/non-cationic lipid/cholesterol/PEG-lipid conjugate Lipid:siRNA ratio |
|---|---|---|
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

DSPC: distearoylphosphatidylcholine; DPPC: dipalmitoylphosphatidylcholine; PEG-DMG: PEG-didimyristoyl glycerol (C14-PEG, or PEG-C14) (PEG with avg mol wt of 2000), PEG-DSG: PEG-distyryl glycerol (C18-PEG, or PEG-C18) (PEG with avg mol wt of 2000); PEG-cDMA: PEG-carbamoyl-1,2-dimyristyloxypropylamine (PEG with avg mol wt of 2000) and SNALP (1,2-Dilinolenyloxy-N,N-dimethylaminopropane (DLinDMA)) comprising formulations are described in WO 2009/127060, which is hereby incorporated by reference.

XTC comprising formulations are described in WO 2010/088537, the entire contents of which are hereby incorporated herein by reference.

MC3 comprising formulations are described, e.g., in United States Patent Publication No. 2010/0324120, the entire contents of which are hereby incorporated by reference.

ALNY-100 comprising formulations are described in WO 2010/054406, the entire contents of which are hereby incorporated herein by reference.

C12-200 comprising formulations are described in WO 2010/129709, the entire contents of which are hereby incorporated herein by reference.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders can be desirable. In some embodiments, oral formulations are those in which dsRNAs featured in the disclosure are administered in conjunction with one or more penetration enhancer surfactants and chelators. Suitable surfactants include fatty acids or esters or salts thereof, bile acids or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the disclosure can be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, U.S. 2003/0027780, and U.S. Pat. No. 6,747,014, each of which is incorporated herein by reference.

Compositions and formulations for parenteral, intraparenchymal (into the brain), intrathecal, intraventricular or intrahepatic administration can include sterile aqueous solutions which can also contain buffers, diluents and other suitable additives such as, but not limited to, penetration enhancers, carrier compounds and other pharmaceutically acceptable carriers or excipients.

Pharmaceutical compositions of the present disclosure include, but are not limited to, solutions, emulsions, and liposome-containing formulations. These compositions can be generated from a variety of components that include, but are not limited to, preformed liquids, self-emulsifying solids and self-emulsifying semisolids. Particularly preferred are formulations that target the brain when treating MAPT associated diseases or disorders.

The pharmaceutical formulations of the present disclosure, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present disclosure can be formulated into any of many possible dosage forms such as, but not limited to, tablets, capsules, gel capsules, liquid syrups, soft gels, suppositories, and enemas. The compositions of the present disclosure can also be formulated as suspensions in aqueous, non-aqueous or mixed media. Aqueous suspensions can further contain substances which increase the viscosity of the suspension including, for example, sodium carboxymethylcellulose, sorbitol or dextran. The suspension can also contain stabilizers.

C. Additional Formulations i. Emulsions

The compositions of the present disclosure can be prepared and formulated as emulsions. Emulsions are typically heterogeneous systems of one liquid dispersed in another in the form of droplets usually exceeding 0.1 m in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution in either aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise, a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

ii. Microemulsions

In one embodiment of the present disclosure, the compositions of RNAi agents and nucleic acids are formulated as microemulsions. A microemulsion can be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245). Typically, microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used, and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (M0310), hexaglycerol monooleate (P0310), hexaglycerol pentaoleate (P0500), decaglycerol monocaprate (MCA750), decaglycerol monooleate (M0750), decaglycerol sequioleate (S0750), decaglycerol decaoleate (DA0750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions can form spontaneously when their components are brought together at ambient temperature. This can be particularly advantageous when formulating thermolabile drugs, peptides or RNAi agents. Microemulsions have also been effective in the transdermal delivery of active components in both cosmetic and pharmaceutical applications. It is expected that the microemulsion compositions and formulations of the present disclosure will facilitate the increased systemic absorption of RNAi agents and nucleic acids from the gastrointestinal tract, as well as improve the local cellular uptake of RNAi agents and nucleic acids.

Microemulsions of the present disclosure can also contain additional components and additives such as sorbitan monostearate (Grill 3), Labrasol, and penetration enhancers to improve the properties of the formulation and to enhance the absorption of the RNAi agents and nucleic acids of the present disclosure. Penetration enhancers used in the microemulsions of the present disclosure can be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

iii. Microparticles

An RNAi agent of the disclosure may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present disclosure employs various penetration enhancers to effect the efficient delivery of nucleic acids, particularly RNAi agents, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, NY, 2002; Lee et al., Critical Reviews in Therapeutic Drug Carrier Systems, 1991, p. 92). Each of the above-mentioned classes of penetration enhancers are described below in greater detail.

Surfactants (or "surface-active agents") are chemical entities which, when dissolved in an aqueous solution, reduce the surface tension of the solution or the interfacial tension between the aqueous solution and another liquid, with the result that absorption of RNAi agents through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, NY, 2002; Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_{1-20}$ alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery, CRC Press, Danvers, M A, 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

The physiological role of bile includes the facilitation of dispersion and absorption of lipids and fat-soluble vitamins (see e.g., Malmsten, M. Surfactants and polymers in drug delivery, Informa Health Care, New York, NY, 2002; Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, NY, 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating agents, as used in connection with the present disclosure, can be defined as compounds that remove metallic ions from solution by forming complexes therewith, with the result that absorption of RNAi agents through the mucosa is enhanced. With regards to their use as penetration enhancers in the present disclosure, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(see e.g., Katdare, A. et al., Excipient development for pharmaceutical, biotechnology, and drug delivery, CRC Press, Danvers, M A, 2006; Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

As used herein, non-chelating non-surfactant penetration enhancing compounds can be defined as compounds that demonstrate insignificant activity as chelating agents or as surfactants but that nonetheless enhance absorption of RNAi agents through the alimentary mucosa (see e.g., Muranishi, Critical Reviews in Therapeutic Drug Carrier Systems, 1990, 7, 1-33). This class of penetration enhancers includes, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of RNAi agents at the cellular level can also be added to the pharmaceutical and other compositions of the present disclosure. For example, cationic lipids, such as lipofectin (Junichi et al, U.S. Pat. No. 5,705,188), cationic glycerol derivatives, and polycationic molecules, such as polylysine (WO 97/30731), are also known to enhance the cellular uptake of dsRNAs.

Other agents can be utilized to enhance the penetration of the administered nucleic acids, including glycols such as ethylene glycol and propylene glycol, pyrrols such as 2-pyrrol, azones, and terpenes such as limonene and menthone.

v. Excipients

In contrast to a carrier compound, a “pharmaceutical carrier” or “excipient” is a pharmaceutically acceptable solvent, suspending agent or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present disclosure. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

vi. Other Components

The compositions of the present disclosure can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present disclosure, such as dyes, flavoring agents, preservatives, antioxidants, opacifiers, thickening agents and stabilizers. However, such materials, when added, should not unduly interfere with the biological activities of the components of the compositions of the present disclosure. The formulations can be sterilized and, if desired, mixed with auxiliary agents, e.g., lubricants, preservatives, stabilizers, wetting agents, emulsifiers, salts for influencing osmotic pressure, buffers, colorings, flavorings or aromatic substances and the like which do not deleteriously interact with the nucleic acid(s) of the formulation.

Aqueous suspensions can contain substances which increase the viscosity of the suspension including, for example, sodium carboxymethylcellulose, sorbitol or dextran. The suspension can also contain stabilizers.

In some embodiments, pharmaceutical compositions featured in the disclosure include (a) one or more RNAi agents and (b) one or more agents which function by a non-RNAi mechanism and which are useful in treating a MAPT-associated disorder. Examples of such agents include, but are not limited to, cholinesterase inhibitors, memantine, monoamine inhibitors, reserpine, anticonvulsants, antipsychotic agents, and antidepressants.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds that exhibit high therapeutic indices are preferred.

The data obtained from cell culture assays and animal studies can be used in formulating a range of dosage for use in humans. The dosage of compositions featured herein in the disclosure lies generally within a range of circulating concentrations that include the $ED_{50}$ with little or no toxicity. The dosage can vary within this range depending upon the dosage form employed and the route of administration utilized. For any compound used in the methods featured in the disclosure, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the $IC_{50}$ (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

In addition to their administration, as discussed above, the RNAi agents featured in the disclosure can be administered in combination with other known agents effective in treatment of pathological processes mediated by nucleotide repeat expression. In any event, the administering physician can adjust the amount and timing of RNAi agent administration on the basis of results observed using standard measures of efficacy known in the art or described herein.

VII. Kits

In certain aspects, the instant disclosure provides kits that include a suitable container containing a pharmaceutical formulation of a siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof).

Such kits include one or more dsRNA agent(s) and instructions for use, e.g., instructions for administering a prophylactically or therapeutically effective amount of a dsRNA agent(s). The dsRNA agent may be in a vial or a pre-filled syringe. The kits may optionally further comprise means for administering the dsRNA agent (e.g., an injection device, such as a pre-filled syringe or an intrathecal pump), or means for measuring the inhibition of MAPT (e.g., means for measuring the inhibition of MAPT mRNA, Tau, and/or MAPT activity). Such means for measuring the inhibition of MAPT may comprise a means for obtaining a sample from a subject, such as, e.g., a CSF and/or plasma sample. The kits of the invention may optionally further comprise means for determining the therapeutically effective or prophylactically effective amount.

In certain embodiments the individual components of the pharmaceutical formulation may be provided in one container. Alternatively, it may be desirable to provide the components of the pharmaceutical formulation separately in two or more containers, e.g., one container for a siRNA compound preparation, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

VIII. Methods for Inhibiting MAPT Expression

The present disclosure also provides methods of inhibiting expression of a MAPT gene in a cell. The methods include contacting a cell with an RNAi agent, e.g., double stranded RNAi agent, in an amount effective to inhibit expression and/or activity of MAPT in the cell, thereby inhibiting expression and/or activity of MAPT in the cell. The present disclosure also provides methods of selective inhibition of exon 10-containing MAPT transcripts in a cell. The methods include contacting the cell with a dsRNA agent of the present disclosure, or a pharmaceutical composition of the present disclosure, thereby selectively degrading exon 10-containing MAPT transcripts in the cell. In certain embodiments, the cell is within a subject. In certain embodiments, the subject is a human. In certain embodiments, the subject has a MAPT-associated disorder. In certain embodiments, the MAPT-associated disorder is a neuro-degenerative disorder. In certain embodiments, the neurodegenerative disorder is associated with an abnormality of MAPT gene encoded protein Tau. In certain embodiments, the abnormality of MAPT gene encoded protein Tau results in aggregation of Tau in subject's brain.

In certain embodiments of the disclosure, MAPT expression and/or activity is inhibited by at least 30% preferentially in CNS (e.g., brain) cells. In specific embodiments, MAPT expression and/or activity is inhibited by at least 30%. In certain embodiments, Tau protein level in serum of the subject is inhibited by at least 30%. In certain other embodiments of the disclosure, MAPT expression and/or activity is inhibited by at least 30% preferentially in hepatocytes.

Contacting of a cell with an RNAi agent, e.g., a double stranded RNAi agent, may be done in vitro or in vivo. Contacting a cell in vivo with the RNAi agent includes contacting a cell or group of cells within a subject, e.g., a human subject, with the RNAi agent. Combinations of in vitro and in vivo methods of contacting a cell are also possible.

Contacting a cell may be direct or indirect, as discussed above. Furthermore, contacting a cell may be accomplished via a targeting ligand, including any ligand described herein or known in the art. In some embodiments, the targeting ligand is a carbohydrate moiety, e.g., a GalNAc ligand, or any other ligand that directs the RNAi agent to a site of interest.

The term "inhibiting," as used herein, is used interchangeably with "reducing," "silencing," "downregulating," "suppressing" and other similar terms, and includes any level of inhibition. In certain embodiments, a level of inhibition, e.g., for an RNAi agent of the instant disclosure, can be assessed in cell culture conditions, e.g., wherein cells in cell culture are transfected via Lipofectamine™-mediated transfection at a concentration in the vicinity of a cell of 10 nM or less, 1 nM or less, etc. Knockdown of a given RNAi agent can be determined via comparison of pre-treated levels in cell culture versus post-treated levels in cell culture, optionally also comparing against cells treated in parallel with a scrambled or other form of control RNAi agent. Knockdown in cell culture of, e.g., at least about 30%, can thereby be identified as indicative of "inhibiting" or "reducing", "downregulating" or "suppressing", etc. having occurred. It is expressly contemplated that assessment of targeted mRNA or encoded protein levels (and therefore an extent of "inhibiting", etc. caused by an RNAi agent of the disclosure) can also be assessed in in vivo systems for the RNAi agents of the instant disclosure, under properly controlled conditions as described in the art.

The phrase "inhibiting MAPT," "inhibiting expression of a MAPT gene" or "inhibiting expression of MAPT," as used herein, includes inhibition of expression of any MAPT gene (such as, e.g., a mouse MAPT gene, a rat MAPT gene, a monkey MAPT gene, or a human MAPT gene) as well as variants or mutants of a MAPT gene that encode a Tau. Thus, the MAPT gene may be a wild-type MAPT gene, a mutant MAPT gene, or a transgenic MAPT gene in the context of a genetically manipulated cell, group of cells, or organism.

"Inhibiting expression of a MAPT gene" includes any level of inhibition of a MAPT gene, e.g., at least partial suppression of the expression of a MAPT gene, such as an inhibition by at least about 25%. In certain embodiments, inhibition is at least about 25%, at least about 30%, at least about 40%, at least about 50%, at least about 60%, at least about 70%, at least about 80%, at least about 90%, or at least about 95%, or at least about 99%, relative to a control level. MAPT inhibition can be measured using the in vitro assay with, e.g., A549 cells and a 10 nM concentration of the RNA agent and the PCR assay as provided in the examples herein, are contemplated to be within the scope of the present disclosure. In some embodiments, MAPT inhibition can be measured using the in vitro assay with BE(2)-C cells. In some embodiments, MAPT inhibition can be measured using the in vitro assay with Neuro-2a cells. In another embodiment, MAPT inhibition can be measured using the in vitro assay with Cos-7 (Dual-Luciferase psiCHECK2 vector). In yet another embodiment, MAPT inhibition can be measured using the in vitro assay with primary mouse hepatocytes.

The expression of a MAPT gene may be assessed based on the level of any variable associated with MAPT gene expression, e.g., MAPT mRNA level (e.g., sense mRNA, antisense mRNA, total MAPT mRNA, sense MAPT repeat-containing mRNA, and/or antisense MAPT repeat-containing mRNA) or Tau level (e.g., total Tau, wild-type Tau, or expanded repeat-containing protein), or, for example, the level of sense- or antisense-containing foci and/or the level of aberrant dipeptide repeat protein.

Inhibition may be assessed by a decrease in an absolute or relative level of one or more of these variables compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

For example, in some embodiments of the methods of the disclosure, expression of a MAPT gene (e.g., as assessed by sense- or antisense-containing foci and/or aberrant dipeptide repeat protein level) is inhibited by at least 20%, 30%, 40%, 50%, 60%, 70%, 80%, 85%, 90%, or 95%, relative to a control level, or to below the level of detection of the assay. In other embodiments of the methods of the disclosure, expression of a MAPT gene (e.g., as assessed by mRNA or protein expression level) is inhibited by at least about 25%, at least about 30%, at least about 40%, at least about 50%, at least about 60%, at least about 70%, at least about 80%, at least about 90%, or at least about 95% relative to a control level. In certain embodiments, the methods include a clinically relevant inhibition of expression of MAPT, e.g. as demonstrated by a clinically relevant outcome after treatment of a subject with an agent to reduce the expression of MAPT.

Inhibition of the expression of a MAPT gene may be manifested by a reduction of the amount of mRNA expressed by a first cell or group of cells (such cells may be present, for example, in a sample derived from a subject) in which a MAPT gene is transcribed and which has or have been treated (e.g., by contacting the cell or cells with an RNAi agent of the disclosure, or by administering an RNAi agent of the disclosure to a subject in which the cells are or were present) such that the expression of a MAPT gene is inhibited, as compared to a second cell or group of cells substantially identical to the first cell or group of cells but which has not or have not been so treated (control cell(s) not treated with an RNAi agent or not treated with an RNAi agent targeted to the gene of interest). The degree of inhibition may be expressed in terms of:

$$\frac{(mRNA\text{ in control cells}) - (mRNA\text{ in treated cells})}{(mRNA\text{ in control cells})} \times 100$$

In other embodiments, inhibition of the expression of a MAPT gene may be assessed in terms of a reduction of a parameter that is functionally linked to a MAPT gene expression, e.g., Tau expression, sense- or antisense-containing foci and/or the level of aberrant dipeptide repeat protein. MAPT gene silencing may be determined in any cell expressing MAPT, either endogenous or heterologous from an expression construct, and by any assay known in the art.

Inhibition of the expression of MAPT gene may be manifested by a reduction in the level of the Tau protein (or functional parameter, e.g., reduction in microtubule assembly) that is expressed by a cell or group of cells (e.g., the level of protein expressed in a sample derived from a subject). As explained above, for the assessment of mRNA suppression, the inhibition of protein expression levels in a treated cell or group of cells may similarly be expressed as a percentage of the level of protein in a control cell or group of cells. In some embodiments, the phrase "inhibiting MAPT", can also refer to the inhibition of Tau protein expression, e.g., at least partial suppression Tau expression, such as an inhibition by at least about 25%. In certain embodiments, inhibition of the MAPT activity is by at least about 25%, at least about 30%, at least about 40%, at least about 50%, at least about 60%, at least about 70%, at least about 80%, at least about 90%, or at least about 95%, or at least about 99%, relative to a control level. Tau protein levels can be measured using the in vitro assay with, e.g., the assay described in (Rubenstein et al. (2015) *J. Neurotrauma* 2015 Marl: 32 (5):342-352; Lim et al. (2014) *Comput Struct Biotechnol J.* 2014; 12(20-21):7-13). MAPT expression can be measured using the in vitro assay with, e.g., the assay described in (Caillet-Boudin et al. (2015) *Mol Neurodegener.* 2015; 10:28; Hefti et al. (2018) *PLoS ONE* 13(4): e0195771).

A control cell or group of cells that may be used to assess the inhibition of the expression of a MAPT gene includes a cell or group of cells that has not yet been contacted with an RNAi agent of the disclosure. For example, the control cell or group of cells may be derived from an individual subject (e.g., a human or animal subject) prior to treatment of the subject with an RNAi agent.

The level of MAPT mRNA that is expressed by a cell or group of cells may be determined using any method known in the art for assessing mRNA expression. In one embodiment, the level of expression of MAPT in a sample is determined by detecting a transcribed polynucleotide, or portion thereof, e.g., mRNA of the MAPT gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene (PreAnalytix, Switzerland). Typical assay formats utilizing ribonucleic acid hybridization include nuclear run-on assays, RT-PCR, RNase protection assays, northern blotting, in situ hybridization, and microarray analysis. Strand specific MAPT mRNAs may be detected using the quantitative RT-PCR and or droplet digital PCR methods described in, for example, Jiang, et al. supra, Lagier-Tourenne, et al., supra and Jiang, et al., supra. Circulating MAPT mRNA may be detected using methods the described in WO2012/177906, the entire contents of which are hereby incorporated herein by reference.

In some embodiments, the level of expression of MAPT is determined using a nucleic acid probe. The term "probe", as used herein, refers to any molecule that is capable of selectively binding to a specific MAPT nucleic acid or protein, or fragment thereof. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses and probe arrays. One method for the determination of mRNA levels involves contacting the isolated mRNA with a nucleic acid molecule (probe) that can hybridize to MAPT mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix® gene chip array. A skilled artisan can readily adapt known mRNA detection methods for use in determining the level of MAPT mRNA.

An alternative method for determining the level of expression of MAPT in a sample involves the process of nucleic acid amplification or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) *Proc. Natl. Acad. Sci. USA* 88:189-193), self sustained sequence replication (Guatelli et al. (1990) *Proc. Natl. Acad. Sci. USA* 87:1874-1878), transcriptional amplification system (Kwoh et al. (1989) *Proc. Natl. Acad. Sci. USA* 86:1173-1177), Q-Beta Replicase (Lizardi et al. (1988) *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the disclosure, the level of expression of MAPT is determined by quantitative fluorogenic RT-PCR (i.e., the TaqMan™ System), by a Dual-Glo® Luciferase assay, or by other art-recognized method for measurement of MAPT expression or mRNA level.

The expression level of MAPT mRNA may be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of MAPT expression level may also comprise using nucleic acid probes in solution.

In some embodiments, the level of mRNA expression is assessed using branched DNA (bDNA) assays or real time PCR (qPCR). The use of this PCR method is described and exemplified in the Examples presented herein. Such methods can also be used for the detection of MAPT nucleic acids.

The level of Tau expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, western blotting, radioimmunoassay (RIA), enzyme-linked immunosorbent assays (ELISAs), immunofluorescent assays, electrochemiluminescence assays, and the like. Such assays can also be used for the detection of proteins indicative of the presence or replication of Tau. Tau protein levels can be measured using the in vitro assay with, e.g., the assay described in (Rubenstein et al. (2015) *J. Neurotrauma* 2015 Marl: 32 (5):342-352; Lim et al. (2014) *Comput Struct Biotechnol J.* 2014; 12(20-21):7-13).

The level of sense- or antisense-containing foci and the level of aberrant dipeptide repeat protein may be assessed using methods well-known to one of ordinary skill in the art, including, for example, fluorescent in situ hybridization (FISH), immunohistochemistry and immunoassay (see, e.g., Jiang, et al. supra). In some embodiments, the efficacy of the methods of the disclosure in the treatment of a MAPT-associated disease is assessed by a decrease in MAPT mRNA level (e.g, by assessment of a CSF sample and/or plasma sample for MAPT level, by brain biopsy, or otherwise).

In some embodiments of the methods of the disclosure, the RNAi agent is administered to a subject such that the RNAi agent is delivered to a specific site within the subject. The inhibition of expression of MAPT may be assessed using measurements of the level or change in the level of MAPT mRNA (e.g., sense mRNA, antisense mRNA, total MAPT mRNA), Tau protein (e.g., total Tau protein, wild-type Tau protein), sense-containing foci, antisense-containing foci, aberrant dipeptide repeat protein in a sample derived from a specific site within the subject, e.g., CNS cells. In certain embodiments, the methods include a clinically relevant inhibition of expression of MAPT, e.g. as demonstrated by a clinically relevant outcome after treatment of a subject with an agent to reduce the expression of MAPT, such as, for example, stabilization or inhibition of caudate atrophy (e.g., as assessed by volumetric MRI (vMRI)), a stabilization or reduction in neurofilament light chain (NfL) levels in a CSF sample from a subject, a reduction in mutant MAPT mRNA or a cleaved mutant Tau, e.g., full-length mutant MAPT mRNA or protein and a cleaved mutant MAPT mRNA or protein.

As used herein, the terms detecting or determining a level of an analyte are understood to mean performing the steps to determine if a material, e.g., protein, RNA, is present. As used herein, methods of detecting or determining include detection or determination of an analyte level that is below the level of detection for the method used.

IX. Methods of Treating or Preventing MAPT-Associated Diseases

The present disclosure also provides methods of using an RNAi agent of the disclosure or a composition containing an RNAi agent of the disclosure to reduce or inhibit MAPT expression in a cell. The methods include contacting the cell with a dsRNA of the disclosure and maintaining the cell for a time sufficient to obtain degradation of the mRNA transcript of a MAPT gene, thereby inhibiting expression of the MAPT gene in the cell.

In addition, the present disclosure also provides methods of using an RNAi agent of the disclosure or a composition containing an RNAi agent of the disclosure to reduce the level and/or inhibit formation of sense- and antisense-containing foci in a cell. The methods include contacting the cell with a dsRNA of the disclosure, thereby reducing the level of the MAPT sense- and antisense-containing foci in the cell.

The present disclosure also provides methods of using an RNAi agent of the disclosure or a composition containing an RNAi agent of the disclosure to reduce the level and/or inhibit formation of aberrant dipeptide repeat protein in a cell. The methods include contacting the cell with a dsRNA of the disclosure, thereby reducing the level of the aberrant dipeptide repeat protein in the cell.

Reduction in gene expression, the level of MAPT sense- and antisense-containing foci, and/or aberrant dipeptide repeat protein can be assessed by any methods known in the art. For example, a reduction in the expression of MAPT may be determined by determining the mRNA expression level of MAPT using methods routine to one of ordinary skill in the art, e.g., northern blotting, qRT-PCR; by determining the protein level of MAPT using methods routine to one of ordinary skill in the art, such as western blotting, immunological techniques.

In the methods of the disclosure the cell may be contacted in vitro or in vivo, i.e., the cell may be within a subject. The subject may be a human. The subject may have a MAPT-associated disorder. The MAPT-associated disorder may be a neurodegenerative disorder. The neurodegenerative disorder of the subject that can be associated with an abnormality of MAPT gene encoded protein Tau. The abnormality of MAPT gene encoded protein Tau may result in aggregation of Tau in subject's brain.

A cell suitable for treatment using the methods of the disclosure may be any cell that expresses a MAPT gene. A cell suitable for use in the methods of the disclosure may be a mammalian cell, e.g., a primate cell (such as a human cell or a non-human primate cell, e.g., a monkey cell or a chimpanzee cell), a non-primate cell (such as a rat cell, or a mouse cell). In one embodiment, the cell is a human cell, e.g., a human CNS cell.

MAPT expression (e.g., as assessed by sense mRNA, antisense mRNA, total MAPT mRNA, total Tau protein) is inhibited in the cell by about 20%, 25%, 30%, 35%, 40%, 45%, or 50% relative to the expression in a control cell. In certain embodiments, MAPT expression is inhibited by at least about 50%, at least about 60%, at least about 70%, at least about 80%, at least about 90%, or at least about 95% relative to a control level.

In preferred embodiments, MAPT expression is inhibited in the cell by at least 30%. In particular embodiments, inhibiting expression of MAPT may decrease Tau protein level in serum of the subject by at least 30%.

Inhibition, as assessed by sense- or antisense-containing foci and/or aberrant dipeptide repeat protein level) is inhibited in the cell by at least 20%, 30%, 40%, preferably at least 50%, 60%, 70%, 80%, 85%, 90%, or 95%, or to below the level of detection of the assay.

The in vivo methods of the disclosure may include administering to a subject a composition containing an RNAi agent, where the RNAi agent includes a nucleotide sequence that is complementary to at least a part of an RNA transcript of the MAPT gene of the mammal to be treated. When the organism to be treated is a mammal such as a human, the composition can be administered by any means known in the art including, but not limited to oral, intraperitoneal, or parenteral routes, including intracranial (e.g., intraventricular, intraparenchymal, and intrathecal), intravenous, intramuscular, intravitreal, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection. In certain embodiments, the compositions are administered by intrathecal injection.

In some embodiments, the administration is via a depot injection. A depot injection may release the RNAi agent in a consistent way over a prolonged time period. Thus, a depot injection may reduce the frequency of dosing needed to obtain a desired effect, e.g., a desired inhibition of MAPT, or a therapeutic or prophylactic effect. A depot injection may also provide more consistent serum concentrations. Depot injections may include subcutaneous injections or intramuscular injections. In preferred embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intracranial, intravenous, subcutaneous, arterial, or epidural infusions. In preferred embodiments, the infusion pump is a subcutaneous infusion pump. In other embodiments, the pump is a surgically implanted pump that delivers the RNAi agent to the CNS.

The mode of administration may be chosen based upon whether local or systemic treatment is desired and based upon the area to be treated. The route and site of administration may be chosen to enhance targeting.

In one aspect, the present disclosure also provides methods for inhibiting the expression of a MAPT gene in a mammal. The methods include administering to the mammal a composition comprising a dsRNA that targets a MAPT gene in a cell of the mammal, thereby inhibiting expression of the MAPT gene in the cell. Reduction in gene expression can be assessed by any methods known it the art and by methods, e.g. qRT-PCR, described herein. Reduction in protein production can be assessed by any methods known it the art and by methods, e.g. ELISA, described herein. In one embodiment, a CNS biopsy sample or a cerebrospinal fluid (CSF) sample serves as the tissue material for monitoring the reduction in MAPT gene or protein expression (or of a proxy therefore).

The present disclosure further provides methods of treatment of a subject in need thereof. The treatment methods of the disclosure include administering an RNAi agent of the disclosure to a subject, e.g., a subject that would benefit from inhibition of MAPT expression, such as a subject having a missense and/or deletion mutations in the MAPT gene, in a therapeutically effective amount of an RNAi agent targeting a MAPT gene or a pharmaceutical composition comprising an RNAi agent targeting a MAPT gene.

In addition, the present disclosure provides methods of preventing, treating or inhibiting the progression of a MAPT-associated disease or disorder (e.g., Alzheimer's disease, FTD, PSP, or another tauopathy), in a subject. The methods include administering to the subject a therapeutically effective amount of any of the RNAi agent, e.g., dsRNA agents, or the pharmaceutical composition provided herein, thereby preventing, treating or inhibiting the progression of a MAPT-associated disease or disorder in the subject. A MAPT-associated disease or disorder that can be prevented by the method of the disclosure can be associated with an abnormality of MAPT gene encoded protein Tau. The abnormality of MAPT gene encoded protein Tau results in aggregation of Tau in subject's brain. The subject may be human. Administration of a dsRNA agent of the disclosure, or a pharmaceutical composition of the disclosure, may cause a decrease in Tau aggregation in the subject's brain.

An RNAi agent of the disclosure may be administered as a "free RNAi agent." A free RNAi agent is administered in the absence of a pharmaceutical composition. The naked RNAi agent may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the RNAi agent can be adjusted such that it is suitable for administering to a subject.

Alternatively, an RNAi agent of the disclosure may be administered as a pharmaceutical composition, such as a dsRNA liposomal formulation.

Subjects that would benefit from a reduction or inhibition of MAPT gene expression are those having a MAPT-associated disease. Exemplary MAPT-associated diseases include, but are not limited to, tauopathy, Alzheimer disease, frontotemporal dementia (FTD), behavioral variant frontotemporal dementia (bvFTD), nonfluent variant primary progressive aphasia (nfvPPA), primary progressive aphasia-semantic (PPA-S), primary progressive aphasia-logopenic (PPA-L), frontotemporal dementia with parkinsonism linked to chromosome 17 (FTDP-17), Pick's disease (PiD), argyrophilic grain disease (AGD), multiple system tauopathy with presenile dementia (MSTD), white matter tauopathy with globular glial inclusions (FTLD with GGIs), FTLD with MAPT mutations, neurofibrillary tangle (NFT) dementia, FTD with motor neuron disease, amyotrophic lateral sclerosis (ALS), corticobasal syndrome (CBS), corticobasal degeneration (CBD), progressive supranuclear palsy (PSP), Parkinson's disease, postencephalitic Parkinsonism, Niemann-Pick disease, Huntington disease, type 1 myotonic dystrophy, and Down syndrome (DS).

The disclosure further provides methods for the use of an RNAi agent or a pharmaceutical composition thereof, e.g., for treating a subject that would benefit from reduction or inhibition of MAPT expression, e.g., a subject having a MAPT-associated disorder, in combination with other pharmaceuticals or other therapeutic methods, e.g., with known pharmaceuticals or known therapeutic methods, such as, for example, those which are currently employed for treating these disorders. For example, in certain embodiments, an RNAi agent targeting MAPT is administered in combination with, e.g., an agent useful in treating a MAPT-associated disorder as described elsewhere herein or as otherwise known in the art. For example, additional agents suitable for treating a subject that would benefit from reduction in MAPT expression, e.g., a subject having a MAPT-associated disorder, may include agents currently used to treat symptoms of MAPT-associated diseases. The RNAi agent and additional therapeutic agents may be administered at the same time or in the same combination, e.g., intrathecally, or the additional therapeutic agent can be administered as part of a separate composition or at separate times or by another method known in the art or described herein.

Exemplary additional therapeutics include, for example, a monoamine inhibitor, e.g., tetrabenazine (Xenazine), deutetrabenazine (Austedo), and reserpine, an anticonvulsant, e.g., valproic acid (Depakote, Depakene, Depacon), and clonazepam (Klonopin), an antipsychotic agent, e.g., risperidone (Risperdal), and haloperidol (Haldol), and an antidepressant, e.g., paroxetine (Paxil).

In one embodiment, the method includes administering a composition featured herein such that expression of the target MAPT gene is decreased, for at least one month. In preferred embodiments, expression is decreased for at least 2 months, 3 months, or 6 months.

Preferably, the RNAi agents useful for the methods and compositions featured herein specifically target RNAs (primary or processed) of the target MAPT gene. Compositions and methods for inhibiting the expression of these genes using RNAi agents can be prepared and performed as described herein.

Administration of the dsRNA according to the methods of the disclosure may result in a reduction of the severity, signs, symptoms, or markers of such diseases or disorders in a patient with a MAPT-associated disorder. By "reduction" in this context is meant a statistically significant or clinically significant decrease in such level. The reduction can be, for example, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100% relative to a control level. Efficacy of treatment or prevention of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. For example, efficacy of treatment of a MAPT-associated disorder may be assessed, for example, by periodic monitoring of a subject's. Comparisons of the later readings with the initial readings provide a physician an indication of whether the treatment is effective. It is well within the ability of one skilled in the art to monitor efficacy of treatment or prevention by measuring any one of such parameters, or any combination of parameters. In connection with the administration of an RNAi agent targeting MAPT or pharmaceutical composition thereof, "effective against" a MAPT-associated disorder indicates that administration in a clinically appropriate manner results in a beneficial effect for at least a statistically significant fraction of patients, such as an improvement of symptoms, a cure, a reduction in disease, extension of life, improvement in quality of life, or other effect generally recognized as positive by medical doctors familiar with treating MAPT-associated disorders and the related causes.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given RNAi agent drug or formulation of that drug can also be judged using an experimental animal model for the given disease as known in the art. When using an experimental animal model, efficacy of treatment is evidenced when a statistically significant reduction in a marker or symptom is observed.

Alternatively, the efficacy can be measured by a reduction in the severity of disease as determined by one skilled in the art of diagnosis based on a clinically accepted disease severity grading scale. Any positive change resulting in e.g., lessening of severity of disease measured using the appropriate scale, represents adequate treatment using an RNAi agent or RNAi agent formulation as described herein.

In certain embodiments, subjects can be administered a therapeutic amount of dsRNA, such as about 0.01 mg/kg to about 200 mg/kg. In other embodiments, subjects can be administered a therapeutic amount of dsRNA, such as about 0.01 mg/kg to about 500 mg/kg. In yet other embodiments, subjects can be administered a therapeutic amount of dsRNA of about 500 mg/kg or more.

The RNAi agent can be administered intrathecally, via intravitreal injection, or by intravenous infusion over a period of time, on a regular basis. In certain embodiments, after an initial treatment regimen, the treatments can be administered on a less frequent basis. Administration of the RNAi agent can reduce MAPT levels, e.g., in a cell, tissue, blood, CSF sample or other compartment of the patient. In one embodiment, administration of the RNAi agent can reduce MAPT levels, e.g., in a cell, tissue, blood, CSF sample or other compartment of the patient by at least about 25%, such as about 25%, about 30%, about 40%, about 50%, about 60%, about 70%, about 80%, about 90%, or about 95% relative to a control level.

Before administration of a full dose of the RNAi agent, patients can be administered a smaller dose, such as a 5% infusion reaction, and monitored for adverse effects, such as an allergic reaction. In another example, the patient can be monitored for unwanted immunostimulatory effects, such as increased cytokine (e.g., TNF-alpha or INF-alpha) levels.

Alternatively, the RNAi agent can be administered subcutaneously, i.e., by subcutaneous injection. One or more injections may be used to deliver the desired, e.g., monthly dose of RNAi agent to a subject. The injections may be repeated over a period of time. The administration may be repeated on a regular basis. In certain embodiments, after an initial treatment regimen, the treatments can be administered on a less frequent basis. A repeat-dose regimen may include administration of a therapeutic amount of RNAi agent on a regular basis, such as monthly or extending to once a quarter, twice per year, once per year. In certain embodiments, the RNAi agent is administered about once per month to about once per quarter (i.e., about once every three months).

Unless otherwise defined, all technical and scientific terms used herein have the same meaning as commonly understood by one of ordinary skill in the art to which this invention belongs. Although methods and materials similar or equivalent to those described herein can be used in the practice or testing of the RNAi agents and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

An informal Sequence Listing is filed herewith and forms part of the specification as filed.

EXAMPLES

Example 1. RNAi Agent Design, Synthesis, Selection, and in Vitro Evaluation

This Example describes methods for the design, synthesis, selection, and in vitro evaluation of MAPT RNAi agents.

Source of Reagents

Where the source of a reagent is not specifically given herein, such reagent can be obtained from any supplier of reagents for molecular biology at a quality/purity standard for application in molecular biology.

Bioinformatics siRNAs targeting the human MAPT transcripts (*Homo sapiens* microtubule associated protein tau (MAPT), transcript variant 4, mRNA, NCBI refseqID NM_016841.4; NCBI GeneID: 4137 and *Homo sapiens* microtubule associated protein tau (MAPT), transcript variant 2, mRNA, NCBI refseqID NM_005910.6; NCBI GeneID: 4137) were designed using custom R and Python scripts. The human NM_016841.4mRNA has a length of 5544 bases. The human NM_005910.6 mRNA has a length of 5639 bases.

A detailed list of the unmodified MAPT sense and antisense strand nucleotide sequences targeting human MAPT transcript variant 4 are shown in Table 3. A detailed list of the modified MAPT sense and antisense strand nucleotide sequences targeting human MAPT transcript variant 4 are shown in Table 4.

A detailed list of the unmodified MAPT sense and antisense strand nucleotide sequences targeting human MAPT transcript variant 2 are shown in Table 5. A detailed list of the modified MAPT sense and antisense strand nucleotide sequences targeting human MAPT transcript variant 2 are shown in Table 6.

It is to be understood that, throughout the application, a duplex name without a decimal is equivalent to a duplex name with a decimal which merely references the batch number of the duplex. For example, AD-1397070 is equivalent to AD-1397070.1.

TABLE 2

Abbreviations of nucleotide monomers used in nucleic acid sequence representation. It will be understood that these monomers, when present in an oligonucleotide, are mutually linked by 5'-3'-phosphodiester bonds, and it is understood that when the nucleotide contains a 2'-fluoro modification, then the fluoro replaces the hydroxy at that position in the parent nucleotide (i.e., it is a 2'-deoxy-2'-fluoronucleotide). It will also be understood that the abbreviations correspond to nucleotides which omit the 3'-phosphate when found at the 3'-terminal position (i.e., they are 3'-OH).

| Abbreviation | Nucleotide(s) |
|---|---|
| A | Adenosine-3'-phosphate |
| Ab | beta-L-adenosine-3'-phosphate |
| Abs | beta-L-adenosine-3'-phosphorothioate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cb | beta-L-cytidine-3'-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |

TABLE 2-continued

Abbreviations of nucleotide monomers used in nucleic acid sequence representation. It will be understood that these monomers, when present in an oligonucleotide, are mutually linked by 5'-3'-phosphodiester bonds, and it is understood that when the nucleotide contains a 2'-fluoro modification, then the fluoro replaces the hydroxy at that position in the parent nucleotide (i.e., it is a 2'-deoxy-2'-fluoronucleotide). It will also be understood that the abbreviations correspond to nucleotides which omit the 3'-phosphate when found at the 3'-terminal position (i.e., they are 3'-OH).

| Abbreviation | Nucleotide(s) |
|---|---|
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide, modified or unmodified |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L96 | N-[tris(GalNAc-alkyl)-amidodecanoyl)]-4-hydroxyprolinol Hyp-(GalNAc-alkyl)3 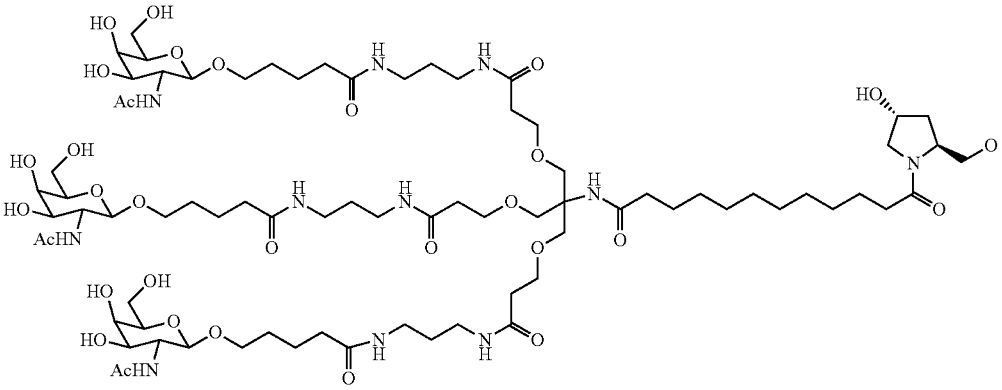 [SMILES: CC(=O)NC1C(OCCCCC(=O)NCCCNC(=O)CCOCC(COCCC(=O)NCCCNC(=O)CCCCOC2OC(CO)C(O)C(O)C2NC(C)=O)(COCCC(=O)NCCCNC(=O)CCCCOC2OC(CO)C(O)C(O)C2NC(C)=O)NC(=O)CCCCCCCCCCC(=O)N2C[C@H](O)C[C@H]2CO)OC(CO)C(O)C1O] i.e. (2S,4R)-1-[29-[[2-(acetylamino)-2-deoxy-β-D-galactopyranosyl]oxy]-14,14-bis[[3-[[3-[[5-[[2-(acetylamino)-2-deoxy-β-D-galactopyranosyl]oxy]-1-oxopentyl]amino]propyl]amino]-3-oxopropoxy]methyl]-1,12,19,25-tetraoxo-16-oxa-13,20,24-triazanonacos-1-yl]-4-hydroxy-2-hydroxymethylpyrrolidine |
| Y34 | 2-hydroxymethyl-tetrahydrofuran-4-methoxy-3-phosphate (abasic 2'-OMe furanose) |
| Y44 | inverted abasic DNA (2-hydroxymethyl-tetrahydrofuran-5-phosphate) |
| (Agn) | Adenosine-glycol nucleic acid (GNA) S-Isomer |
| (Cgn) | Cytidine-glycol nucleic acid (GNA) S-Isomer |
| (Ggn) | Guanosine-glycol nucleic acid (GNA) S-Isomer |
| (Tgn) | Thymidine-glycol nucleic acid (GNA) S-Isomer |
| P | Phosphate |
| VP | Vinyl-phosphonate |
| dA | 2'-deoxyadenosine-3'-phosphate |
| dAs | 2'-deoxyadenosine-3-phosphorothioate |
| dC | 2'-deoxycytidine-3'-phosphate |
| dCs | 2'-deoxycytidine-3'-phosphorothioate |
| dG | 2'-deoxyguanosine-3'-phosphate |
| dGs | 2'-deoxyguanosine-3'-phosphorothioate |
| dT | 2'-deoxythymidine-3'-phosphate |
| dTs | 2'-deoxythymidine-3'-phosphorothioate |
| dU | 2'-deoxyuridine |
| dUs | 2'-deoxyuridine-3-phosphorothioate |
| (Ahd) | 2'-O-hexadecyl-adenosine-3'-phosphate |
| (Ahds) | 2'-O-hexadecyl-adenosine-3'-phosphorothioate |
| (Chd) | 2'-O-hexadecyl-cytidine-3'-phosphate |
| (Chds) | 2'-O-hexadecyl-cytidine-3'-phosphorothioate |
| (Ghd) | 2'-O-hexadecyl-guanosine-3'-phosphate |
| (Ghds) | 2'-O-hexadecyl-guanosine-3'-phosphorothioate |
| (Uhd) | 2'-O-hexadecyl-uridine-3'-phosphate |
| (Uhds) | 2'-O-hexadecyl-uridine-3'-phosphorothioate |
| (A2p) | adenosine-2'-phosphate |
| (C2p) | cytidine-2'-phosphate |
| (G2p) | guanosine-2'-phosphate |
| (U2p) | uridine-2'-phosphate |

TABLE 2-continued

Abbreviations of nucleotide monomers used in nucleic acid sequence representation. It will be understood that these monomers, when present in an oligonucleotide, are mutually linked by 5'-3'-phosphodiester bonds, and it is understood that when the nucleotide contains a 2'-fluoro modification, then the fluoro replaces the hydroxy at that position in the parent nucleotide (i.e., it is a 2'-deoxy-2'-fluoronucleotide). It will also be understood that the abbreviations correspond to nucleotides which omit the 3'-phosphate when found at the 3'-terminal position (i.e., they are 3'-OH).

| Abbreviation | Nucleotide(s) |
|---|---|
| (T2p) | thymidine 2'-phosphate |
| (A2ps) | adenosine-2'-phosphorothioate |
| (C2ps) | cytidine-2'-phosphorothioate |
| (G2ps) | guanosine-2'-phosphorothioate |
| (U2ps) | uridine-2'-phosphorothioate |
| (T2ps) | thymidine 2'-phosphorothioate |

TABLE 3

Unmodified Sense and Antisense Strand Sequences of MAPT dsRNA Agents

| Duplex Name | Sense Sequence 5' to 3' | SEQ ID NO: | Range in NM_016841.4 | Antisense Sequence 5' to 3' | SEQ ID NO: | Range in NM_016841.4 |
|---|---|---|---|---|---|---|
| AD-1397070 | ACGUGACCCAAGCUCGCAUGA | 13 | 510-530 | UCAUGCGAGCUTGGGUCACGUGA | 259 | 508-530 |
| AD-1397072 | GUGACCCAAGCUCGCAUGGUA | 14 | 512-532 | UACCAUGCGAGCUUGGGUCACGU | 260 | 510-532 |
| AD-1397073 | UGACCCAAGCUCGCAUGGUCA | 15 | 513-533 | UGACCATGCGAGCUUGGGUCACG | 261 | 511-533 |
| AD-1397075 | ACCCAAGCUCGCAUGGUCAGA | 16 | 515-535 | UCUGACCAUGCGAGCUUGGGUCA | 262 | 513-535 |
| AD-1397081 | AUAGUCUACAAACCAGUUGAA | 17 | 977-997 | UUCAACTGGUUUGUAGACUAUUU | 263 | 975-997 |
| AD-1397083 | GUCUACAAACCAGUUGACCUA | 18 | 980-1000 | UAGGTCAACUGGUUUGUAGACUA | 264 | 978-1000 |
| AD-1397088 | AUCUGAGAAGCUUGACUUCAA | 19 | 1075-1095 | UUGAAGTCAAGCUUCUCAGAUUU | 265 | 1073-1095 |
| AD-1397249 | GAAAUAAAGUUAUUACUCUGA | 20 | 5519-5539 | UCAGAGTAAUAACUUUAUUUCCA | 266 | 5517-5539 |
| AD-1397252 | GCUCGCAUGGUCAGUAAAAGA | 21 | 521-541 | UCUUTUACUGACCAUGCGAGCUU | 267 | 519-541 |
| AD-1397253 | CUCGCAUGGUCAGUAAAAGCA | 22 | 522-542 | UGCUTUTACUGACCAUGCGAGCU | 268 | 520-542 |
| AD-1397258 | AUGGUCAGUAAAAGCAAAGAA | 23 | 527-547 | UUCUTUGCUUUUACUGACCAUGC | 269 | 525-547 |
| AD-1397261 | GUCAGUAAAAGCAAAGACGGA | 24 | 530-550 | UCCGTCTUUGCTUUUACUGACCA | 270 | 528-550 |
| AD-1397262 | UCAGUAAAAGCAAAGACGGGA | 25 | 531-551 | UCCCGUCUUUGCUUUUACUGACC | 271 | 529-551 |
| AD-1397263 | CAGUAAAAGCAAAGACGGGAA | 26 | 532-552 | UTCCCGTCUUUGCUUUUACUGAC | 272 | 530-552 |
| AD-1397291 | GCAAAUAGUCUACAAACCAGA | 27 | 973-993 | UCUGGUTUGUAGACUAUUUGCAC | 273 | 971-993 |
| AD-1397293 | AAAUAGUCUACAAACCAGUUA | 28 | 975-995 | UAACTGGUUUGUAGACUAUUUGC | 274 | 973-995 |
| AD-1397294 | AAUAGUCUACAAACCAGUUGA | 29 | 976-996 | UCAACUGGUUUGUAGACUAUUUG | 275 | 974-996 |
| AD-1397295 | UAGUCUACAAACCAGUUGACA | 30 | 978-998 | UGUCAACUGGUTUGUAGACUAUU | 276 | 976-998 |

TABLE 3-continued

Unmodified Sense and Antisense Strand Sequences of MAPT dsRNA Agents

| Duplex Name | Sense Sequence 5' to 3' | SEQ ID NO: | Range in NM_016841.4 | Antisense Sequence 5' to 3' | SEQ ID NO: | Range in NM_016841.4 |
|---|---|---|---|---|---|---|
| AD-1397298 | UACAAACCAGUUGACCUGAGA | 31 | 983-1003 | UCUCAGGUCAACUGGUUUGUAGA | 277 | 981-1003 |
| AD-1397299 | ACAAACCAGUUGACCUGAGCA | 32 | 984-1004 | UGCUCAGGUCAACUGGUUUGUAG | 278 | 982-1004 |
| AD-1637732 | UGAAUUUGGAAAUAAAGUUAA | 33 | 5511-5531 | UTAACUTUAUUTCCAAAUUCACU | 279 | 5509-5531 |
| AD-1637733 | UGAAUUUGGAAAUAAAGUUAA | 34 | 5511-5531 | UUAACUTUAUUUCCAAAUUCACU | 280 | 5509-5531 |
| AD-1637734 | GAAUUUGGAAAUAAAGUUAUA | 35 | 5512-5532 | UAUAACTUUAUUUCCAAAUUCAC | 281 | 5510-5532 |
| AD-1637735 | AAUUUGGAAAUAAAGUUAUUA | 36 | 5513-5533 | UAAUAACUUUATUUCCAAAUUCA | 282 | 5511-5533 |
| AD-1637736 | AUUUGGAAAUAAAGUUAUUAA | 37 | 5514-5534 | UTAATAACUUUAUUUCCAAAUUC | 283 | 5512-5534 |
| AD-1637737 | AUUUGGAAAUAAAGUUAUUAA | 38 | 5514-5534 | UUAATAACUUUAUUUCCAAAUUC | 284 | 5512-5534 |
| AD-1637739 | GGAAAUAAAGUUAUUACUCUA | 39 | 5518-5538 | UAGAGUAAUAACUUUAUUUCCAA | 285 | 5516-5538 |
| AD-1637744 | UAAAGUUAUUACUCUGAUUAA | 40 | 5523-5543 | UUAATCAGAGUAAUAACUUUAUU | 286 | 5521-5543 |
| AD-1637745 | GUGACCCAAGCUCGCAUGGUA | 41 | 512-532 | UACCAUGCGAGCUUGGGUCACGU | 287 | 510-532 |
| AD-1637746 | GUGACCCAAGCUCGCAUGGUA | 42 | 512-532 | UACCAUGCGAGCUUGGGUCACGU | 288 | 510-532 |
| AD-1637747 | GUGACCCAAGCUCGCAUGGUA | 43 | 512-532 | UACCAUGCGAGCUUGGGUCACGU | 289 | 510-532 |
| AD-1637748 | GUGACCCAAGCTCGCAUGGUA | 44 | 512-532 | UACCAUGCGAGCUUGGGUCACGU | 290 | 510-532 |
| AD-1637749 | GUGACCCAAGCUCGCAUGGUA | 45 | 512-532 | UACCAUGCGAGCUUGGGUCACGU | 291 | 510-532 |
| AD 1637750 | GUGACCCAAGCUCGCAUGGUA | 46 | 512-532 | UACCAUGCGAGCUUGGGUCACGU | 292 | 510-532 |
| AD-1637751 | GUGAGCCAAGCUCGCAUGGUA | 47 | 512-532 | UACCAUGCGAGCUUGGCUCACGU | 293 | 510-532 |
| AD-1637752 | GUGAACCAAGCUCGCAUGGUA | 48 | 512-532 | UACCAUGCGAGCUUGGUUCACGU | 294 | 510-532 |
| AD-1637753 | GUGUCCCAAGCUCGCAUGGUA | 49 | 512-532 | UACCAUGCGAGCUUGGGACACGU | 295 | 510-532 |
| AD-1637754 | GUCACCCAAGCUCGCAUGGUA | 50 | 512-532 | UACCAUGCGAGCUUGGGUGACGU | 296 | 510-532 |
| AD-1637755 | GUUACCCAAGCUCGCAUGGUA | 51 | 512-532 | UACCAUGCGAGCUUGGGUAACGU | 297 | 510-532 |
| AD-1637756 | GUGACCCAAGCUCGCAUGGUA | 52 | 512-532 | UACCATGCGAGCUUGGGUCACGU | 298 | 510-532 |
| AD-1637757 | GUGACCCAAGCUCGCAUGGUA | 53 | 512-532 | UACCATGCGAGCUUGGGUCACGU | 299 | 510-532 |
| AD-1637758 | GUGACCCAAGCUCGCAUGGUA | 54 | 512-532 | UACCATGCGAGCUUGGGUCACGU | 300 | 510-532 |

TABLE 3-continued

Unmodified Sense and Antisense Strand Sequences of MAPT dsRNA Agents

| Duplex Name | Sense Sequence 5' to 3' | SEQ ID NO: | Range in NM_016841.4 | Antisense Sequence 5' to 3' | SEQ ID NO: | Range in NM_016841.4 |
|---|---|---|---|---|---|---|
| AD-1637759 | GUGACCCAAGCUCGCAUGGUA | 55 | 512-532 | UACCATGCGAGCUUGGGUCACGU | 301 | 510-532 |
| AD-1637760 | GUGACCCAAGCUCGCAUGGUA | 56 | 512-532 | UACCAUGCGAGCUUGGGUCACGU | 302 | 510-532 |
| AD-1637761 | GUGACCCAAGCUCGCUUGGUA | 57 | 512-532 | UACCAAGCGAGCUUGGGUCACGU | 303 | 510-532 |
| AD-1637762 | GUGACCCAAGCUCGUAUGGUA | 58 | 512-532 | UACCAUACGAGCUUGGGUCACGU | 304 | 510-532 |
| AD-1637763 | GUGACCCAAGCUCGCAUGGUA | 59 | 512-532 | UACCAUGCGAGCUUGGGUCACGU | 305 | 510-532 |
| AD-1637764 | GUGACCCAAGCUCGCUUGGUA | 60 | 512-532 | UACCAAGCGAGCUUGGGUCACGU | 306 | 510-532 |
| AD-1637765 | GUGACCCAAGCUCGUAUGGUA | 61 | 512-532 | UACCAUACGAGCUUGGGUCACGU | 307 | 510-532 |
| AD-1637766 | UACAAACCAGUUGACCUGAGA | 62 | 983-1003 | UCUCAGGUCAACUGGUUUGUAGG | 308 | 981-1003 |
| AD-1637767 | UACAAACCAGUUGACCUGAGA | 63 | 983-1003 | UCUCAGGUCAACUGGTUUGUAGG | 309 | 981-1003 |
| AD-1637768 | UACAAACCAGUUGACCUGAGA | 64 | 983-1003 | UCUCAGGUCAACUGGTUUGUAGG | 310 | 981-1003 |
| AD-1637769 | UACAAACCAGUUGACCUGAGA | 65 | 983-1003 | UCUCAGGUCAACUGGTUUGUAGG | 311 | 981-1003 |
| AD-1637770 | UACAAACCAGUUGACCUGAGA | 66 | 983-1003 | UCUCAGGUCAACUGGUUUGUAGA | 312 | 981-1003 |
| AD-1637771 | UACAAACCAGUUGACCUGAGA | 67 | 983-1003 | UCUCAGGTCAACUGGUUUGUAGG | 313 | 981-1003 |
| AD-1637772 | UACAAACCAGUUGACCUGAGA | 68 | 983-1003 | UCUCAGGTCAACUGGTUUGUAGG | 314 | 981-1003 |
| AD-1637773 | UACAAACCAGUUGACCUGAGA | 69 | 983-1003 | UCUCAGGTCAACUGGTUUGUAGG | 315 | 981-1003 |
| AD-1637774 | UACAAACCAGUUGACCUGAGA | 70 | 983-1003 | UCUCAGGUCAACUGGUUUGUAGG | 316 | 981-1003 |
| AD-1637775 | UACAAACCAGUUGACGUGAGA | 71 | 983-1003 | UCUCACGUCAACUGGUUUGUAGG | 317 | 981-1003 |
| AD-1637776 | UACAAACCAGUUGACUUGAGA | 72 | 983-1003 | UCUCAAGUCAACUGGUUUGUAGG | 318 | 981-1003 |
| AD-1637777 | UACAAACCAGUUGAUCUGAGA | 73 | 983-1003 | UCUCAGAUCAACUGGUUUGUAGG | 319 | 981-1003 |
| AD-1637778 | UACAAACCAGUUGACGUGAGA | 74 | 983-1003 | UCUCACGUCAACUGGUUUGUAGG | 320 | 981-1003 |
| AD-1637779 | UACAAACCAGUUGACUUGAGA | 75 | 983-1003 | UCUCAAGUCAACUGGUUUGUAGG | 321 | 981-1003 |
| AD-1637780 | UACAAACCAGUUGAUCUGAGA | 76 | 983-1003 | UCUCAGAUCAACUGGUUUGUAGG | 322 | 981-1003 |
| AD-1637781 | CAAACCAGUUGACCUGAGA | 77 | 985-1003 | UCUCAGGUCAACUGGUUUGUG | 323 | 983-1003 |
| AD-1637782 | CAAACCAGUUGACCUGAGA | 78 | 985-1003 | UCUCAGGUCAACUGGUUUGUG | 324 | 983-1003 |

TABLE 3-continued

Unmodified Sense and Antisense Strand Sequences of MAPT dsRNA Agents

| Duplex Name | Sense Sequence 5' to 3' | SEQ ID NO: | Range in NM_016841.4 | Antisense Sequence 5' to 3' | SEQ ID NO: | Range in NM_016841.4 |
|---|---|---|---|---|---|---|
| AD-1637783 | GUCUACAAACCAGUUGACCUA | 79 | 980-1000 | UAGGTCAACUGGUUUGUAGACUG | 325 | 978-1000 |
| AD-1637784 | GUCUACAAACCAGUUGACCUA | 80 | 980-1000 | UAGGUCAACUGGUUUGUAGACUG | 326 | 978-1000 |
| AD-1637785 | GUCUUCAAACCAGUUGACCUA | 81 | 980-1000 | UAGGTCAACUGGUUUGAAGACUG | 327 | 978-1000 |
| AD-1637786 | GUCAACAAACCAGUUGACCUA | 82 | 980-1000 | UAGGTCAACUGGUUUGUUGACUG | 328 | 978-1000 |
| AD-1637787 | GUGUACAAACCAGUUGACCUA | 83 | 980-1000 | UAGGTCAACUGGUUUGUACACUG | 329 | 978-1000 |
| AD-1637788 | GUCUACAAACCAGUUGACCUA | 184 | 980-1000 | UAGGTCAACUGGUUUGUAGACUG | 330 | 978-1000 |
| AD-1637789 | GUCUACAAACCAGUUGACCUA | 85 | 980-1000 | UAGGTCAACUGGUUUGUAGACUG | 331 | 978-1000 |
| AD-1637790 | GUCUACAAACCAGUUUACCUA | 86 | 980-1000 | UAGGTAAACUGGUUUGUAGACUG | 332 | 978-1000 |
| AD-1637791 | GUCUACAAACCAGUUUACCUA | 87 | 1980-1000 | UAGGTAAACUGGUUUGUAGACUG | 333 | 978-1000 |
| AD-1637792 | AUAGUCUACAAACCAGUUGAA | 88 | 977-997 | UUCAACTGGUUUGUAGACUAUUU | 334 | 975-997 |
| AD-1637793 | AUAGUCUACAAACCAGUUGAA | 89 | 977-997 | UUCAACTGGUUTGUAGACUAUUU | 335 | 975-997 |
| AD-1637794 | AUAGUCUACAAACCAGUUGAA | 90 | 977-997 | UUCAACTGGUUTGUAGACUAUUU | 336 | 975-997 |
| AD-1637795 | AUAGUCUACAAACCAGUUGAA | 91 | 977-997 | UTCAACTGGUUTGUAGACUAUUU | 337 | 975-997 |
| AD-1637796 | AUAGUCUACAAACCAGUUGAA | 92 | 977-997 | UTCAACTGGUUTGUAGACUAUCU | 338 | 975-997 |
| AD-1637797 | UAGUCUACAAACCAGUUGAA | 93 | 978-997 | UUCAACTGGUUTGUAGACUAUC | 339 | 976-997 |
| AD-1637798 | AGUCUACAAACCAGUUGAA | 94 | 979-997 | UUCAACTGGUUTGUAGACUGU | 340 | 977-997 |
| AD-1637799 | AUAGACUACAAACCAGUUGAA | 95 | 977-997 | UTCAACTGGUUTGUAGUCUAUCU | 341 | 975-997 |
| AD-1637800 | AUACUCUACAAACCAGUUGAA | 96 | 977-997 | UTCAACTGGUUTGUAGAGUAUCU | 342 | 975-997 |
| AD-1637801 | AUUGUCUACAAACCAGUUGAA | 97 | 977-997 | UTCAACTGGUUTGUAGACAAUCU | 343 | 975-997 |
| AD-1637802 | AUAGUCUACAAACCAAUUGAA | 98 | 977-997 | UTCAAUTGGUUTGUAGACUAUCU | 344 | 975-997 |
| AD-1637803 | AUAGUCUACAAACCUGUUGAA | 99 | 977-997 | UTCAACAGGUUTGUAGACUAUCU | 345 | 975-997 |
| AD-1637804 | AUAGUCUACAAACCCGUUGAA | 100 | 977-997 | UTCAACGGGUUTGUAGACUAUCU | 346 | 975-997 |
| AD-1637805 | AUAGUCUACAAACCGGUUGAA | 101 | 977-997 | UTCAACCGGUUTGUAGACUAUCU | 347 | 975-997 |
| AD-1637806 | AAAUAGUCUACAAACCAGUUA | 102 | 975-995 | UAACTGGUUUGUAGACUAUUUGC | 348 | 973-995 |

TABLE 3-continued

Unmodified Sense and Antisense Strand Sequences of MAPT dsRNA Agents

| Duplex Name | Sense Sequence 5' to 3' | SEQ ID NO: | Range in NM_016841.4 | Antisense Sequence 5' to 3' | SEQ ID NO: | Range in NM_016841.4 |
|---|---|---|---|---|---|---|
| AD-1637807 | AAAUAGUCUACAAACCAGUUA | 103 | 975-995 | UAACTGGUUUGTAGACUAUUUGC | 349 | 973-995 |
| AD-1637808 | AAAUAGUCUACAAACCAGUUA | 104 | 975-995 | UAACTGGUUUGTAGACUAUUUGC | 350 | 973-995 |
| AD-1637809 | AAAUAGUCUACAAACCAGUUA | 105 | 975-995 | UAACTGGUUUGTAGACUAUUUCU | 351 | 973-995 |
| AD-1637810 | AAAUUGUCUACAAACCAGUUA | 106 | 975-995 | UAACTGGUUUGUAGACAAUUUGC | 352 | 973-995 |
| AD-1637811 | AAAAAGUCUACAAACCAGUUA | 107 | 975-995 | UAACTGGUUUGUAGACUUUUUGC | 353 | 973-995 |
| AD-1637812 | AAUUAGUCUACAAACCAGUUA | 108 | 975-995 | UAACTGGUUUGUAGACUAAUUGC | 354 | 973-995 |
| AD-1637813 | AAAUAGUCUACAAACCAGUUA | 109 | 975-995 | UAACUGGTUUGUAGACUAUUUGC | 355 | 973-995 |
| AD-1637814 | AAAUAGUCUACAAACCAGUUA | 110 | 975-995 | UAACUGGTUUGTAGACUAUUUGC | 356 | 973-995 |
| AD-1637815 | AAAUAGUCUACAAACGAGUUA | 111 | 975-995 | UAACTCGUUUGTAGACUAUUUGC | 357 | 973-995 |
| AD-1637816 | GCUCGCAUGGUCAGUAAAAGA | 112 | 521-541 | UCUUTUACUGACCAUGCGAGCUU | 358 | 519-541 |
| AD-1637817 | GCUCGCAUGGUCAGUAAAAGA | 113 | 521-541 | UCUUTUACUGACCAUGCGAGCUU | 359 | 519-541 |
| AD-1637818 | GCUCGCAUGGUCAGUAAAAGA | 114 | 521-541 | UCUUTUACUGACCAUGCGAGCUU | 360 | 519-541 |
| AD-1637819 | GCUCCCAUGGUCAGUAAAAGA | 115 | 521-541 | UCUUTUACUGACCAUGGGAGCUU | 361 | 519-541 |
| AD-1637820 | GCUGGCAUGGUCAGUAAAAGA | 116 | 521-541 | UCUUTUACUGACCAUGCCAGCUU | 362 | 519-541 |
| AD-1637821 | GCACGCAUGGUCAGUAAAAGA | 117 | 521-541 | UCUUTUACUGACCAUGCGUGCUU | 363 | 519-541 |
| AD-1637822 | GCUCGCAUGGUCAUUAAAAGA | 118 | 521-541 | UCUUTUAAUGACCAUGCGAGCUU | 364 | 519-541 |
| AD-1637823 | GCUCGCAUGGUCAGUUAAAGA | 119 | 521-541 | UCUUTAACUGACCAUGCGAGCUU | 365 | 519-541 |
| AD-1637824 | GCUCCCAUGGUCACUAAAAGA | 120 | 521-541 | UCUUTUAAUGACCAUGGGAGCUU | 366 | 519-541 |
| AD-1637825 | GCUCCCAUGGUCAGUUAAAGA | 121 | 521-541 | UCUUTAACUGACCAUGGGAGCUU | 367 | 519-541 |
| AD-1637826 | GCUGGCAUGGUCACUAAAAGA | 122 | 521-541 | UCUUTUAAUGACCAUGCCAGCUU | 368 | 519-541 |
| AD-1637827 | GCUGGCAUGGUCAGUUAAAGA | 123 | 521-541 | UCUUTAACUGACCAUGCCAGCUU | 369 | 519-541 |
| AD-1637828 | GCACGCAUGGUCACUAAAAGA | 124 | 521-541 | UCUUTUAAUGACCAUGCGUGCUU | 370 | 519-541 |
| AD-1637829 | GCACGCAUGGUCAGUUAAAGA | 125 | 521-541 | UCUUTAACUGACCAUGCGUGCUU | 371 | 519-541 |
| AD-1637830 | AUCUGAGAAGCUUGACUUCAA | 126 | 1075-1095 | UUGAAGUCAAGCUUCUCAGAUUU | 372 | 1073-1095 |

TABLE 3-continued

Unmodified Sense and Antisense Strand Sequences of MAPT dsRNA Agents

| Duplex Name | Sense Sequence 5' to 3' | SEQ ID NO: | Range in NM_016841.4 | Antisense Sequence 5' to 3' | SEQ ID NO: | Range in NM_016841.4 |
|---|---|---|---|---|---|---|
| AD-1637831 | AUCUGAGAAGCUUGACUUCAA | 127 | 1075-1095 | UUGAAGTCAAGCUUCUCAGAUUU | 373 | 1073-1095 |
| AD-1637832 | AUCUGAGAAGCUUGACUUCAA | 128 | 1075-1095 | UUGAAGTCAAGCUUCTCAGAUUU | 374 | 1073-1095 |
| AD-1637833 | AUCUGAGAAGCUUGACUUCAA | 129 | 1075-1095 | UTGAAGTCAAGCUUCTCAGAUUU | 375 | 1073-1095 |
| AD-1637834 | AUCUGAGAAGCUUGACUUCAA | 130 | 1075-1095 | UTGAAGTCAAGCUTCTCAGAUUU | 376 | 1073-1095 |
| AD-1637835 | AUCUCAGAAGCUUGACUUCAA | 131 | 1075-1095 | UUGAAGTCAAGCUUCUGAGAUUU | 377 | 1073-1095 |
| AD-1637836 | AUCUUAGAAGCUUGACUUCAA | 132 | 1075-1095 | UUGAAGTCAAGCUUCUAAGAUUU | 378 | 1073-1095 |
| AD-1637837 | AUCAGAGAAGCUUGACUUCAA | 133 | 1075-1095 | UUGAAGTCAAGCUUCUCUGAUUU | 379 | 1073-1095 |
| AD-1637838 | AUGUGAGAAGCUUGACUUCAA | 134 | 1075-1095 | UUGAAGTCAAGCUUCUCACAUUU | 380 | 1073-1095 |
| AD-1637839 | AUAUGAGAAGCUUGACUUCAA | 135 | 1075-1095 | UUGAAGTCAAGCUUCUCAUAUUU | 381 | 1073-1095 |
| AD-1637840 | AUCUGAGAAGCUUGAUUUCAA | 136 | 1075-1095 | UUGAAATCAAGCUUCUCAGAUUU | 382 | 1073-1095 |
| AD-1637841 | CCGAGAAGCUUGACUUCAA | 137 | 1077-1095 | UUGAAGTCAAGCUUCUCAGGU | 383 | 1075-1095 |
| AD-1637842 | CCGAGAAGCUUGACUUCAA | 138 | 1077-1095 | UTGAAGTCAAGCUUCTCAGGU | 384 | 1075-1095 |
| AD-1637843 | AUGGUCAGUAAAAGCAAAGAA | 139 | 527-547 | UUCUUUGCUUUTACUGACCAUGC | 385 | 525-547 |
| AD-1637844 | AUGGUCAGUAAAAGCAAAGAA | 140 | 527-547 | UUCUUUGCUUUTACUGACCAUGC | 386 | 525-547 |
| AD-1637845 | AUGGUCAGUAAAAGCAAAGAA | 141 | 527-547 | UTCUUUGCUUUTACUGACCAUGC | 387 | 525-547 |
| AD-1637846 | AUGGUCAGTAAAAGCAAAGAA | 142 | 527-547 | UTCUUUGCUUUTACUGACCAUGC | 1017 | 525-547 |
| AD-1637847 | AUGGUCAGTAAAAGCAAAGAA | 143 | 527-547 | UTCUUUGCUUUTACUGACCAUGC | 1018 | 525-547 |
| AD-1637848 | AUGGACAGUAAAAGCAAAGAA | 144 | 527-547 | UTCUUUGCUUUTACUGUCCAUGC | 1019 | 525-547 |
| AD-1637849 | AUGCUCAGUAAAAGCAAAGAA | 145 | 527-547 | UTCUUUGCUUUTACUGAGCAUGC | 1020 | 525-547 |
| AD-1637850 | AUCGUCAGUAAAAGCAAAGAA | 146 | 527-547 | UTCUUUGCUUUTACUGACGAUGC | 1021 | 525-547 |
| AD-1637851 | AUGGUCAGUAAAAGCAAAGAA | 147 | 527-547 | UUCUUUGCUUUUACUGACCAUGC | 1022 | 525-547 |
| AD-1637852 | AUGGUCAGUAAAAGCAAAGAA | 148 | 527-547 | UUCUUTGCUUUTACUGACCAUGC | 1023 | 525-547 |
| AD-1637853 | AUGGUCAGUAAAAGCAAAGAA | 149 | 527-547 | UTCUUTGCUUUTACUGACCAUGC | 1024 | 525-547 |
| AD-1637854 | AUGGUCAGUAAAAGCGAAGAA | 150 | 527-547 | UTCUUCGCUUUTACUGACCAUGC | 1025 | 525-547 |

TABLE 3-continued

Unmodified Sense and Antisense Strand Sequences of MAPT dsRNA Agents

| Duplex Name | Sense Sequence 5' to 3' | SEQ ID NO: | Range in NM_016841.4 | Antisense Sequence 5' to 3' | SEQ ID NO: | Range in NM_016841.4 |
|---|---|---|---|---|---|---|
| AD-1637855 | AUGGUCAGUAAAAGUAAAGAA | 151 | 527-547 | UTCUTUACUUUTACUGACCAUGC | 1026 | 525-547 |
| AD-1637856 | AUGGUCAGUAAAAGAAAAGAA | 152 | 527-547 | UTCUTUTCUUUTACUGACCAUGC | 1027 | 525-547 |
| AD-1637857 | GCAAACCAGUUGACCUGAGCA | 153 | 984-1004 | UGCTCAGGUCAACUGGUUUGUAG | 1028 | 982-1004 |
| AD-1637858 | GCAAUCCAGUUGACCUGAGCA | 154 | 984-1004 | UGCTCAGGUCAACUGGAUUGUAG | 1029 | 982-1004 |
| AD-1637859 | GCAUACCAGUUGACCUGAGCA | 155 | 984-1004 | UGCTCAGGUCAACUGGUAUGUAG | 1030 | 982-1004 |
| AD-1637860 | GCUAACCAGUUGACCUGAGCA | 156 | 984-1004 | UGCTCAGGUCAACUGGUUAGUAG | 1031 | 982-1004 |
| AD-1637861 | GCAAACCAGUUGACUUGAGCA | 157 | 984-1004 | UGCUCAAGUCAACUGGUUUGUAG | 1032 | 982-1004 |
| AD-1637862 | GCAAUCCAGUUGACUUGAGCA | 158 | 984-1004 | UGCUCAAGUCAACUGGAUUGUAG | 1033 | 982-1004 |
| AD-1637863 | GCAUACCAGUUGACUUGAGCA | 159 | 984-1004 | UGCUCAAGUCAACUGGUAUGUAG | 1034 | 982-1004 |
| AD-1637864 | GCUAACCAGUUGACUUGAGCA | 160 | 984-1004 | UGCUCAAGUCAACUGGUUAGUAG | 1035 | 982-1004 |
| AD-1637865 | GCAAACCAGUUGACCUGAGCA | 161 | 984-1004 | UGCUCUGGUCAACUGGUUUGUAG | 1036 | 982-1004 |
| AD-1637866 | GCAAUCCAGUUGACCAGAGCA | 162 | 984-1004 | UGCUCUGGUCAACUGGAUUGUAG | 1037 | 982-1004 |
| AD-1637867 | GCAUACCAGUUGACCAGAGCA | 163 | 984-1004 | UGCUCUGGUCAACUGGUAUGUAG | 1038 | 982-1004 |
| AD-1637868 | GCUAACCAGUUGACCAGAGCA | 164 | 984-1004 | UGCUCUGGUCAACUGGUUAGUAG | 1039 | 982-1004 |
| AD-1637869 | UGGAAAUAAAGUUAUUACUCA | 165 | 5517-5537 | UGAGUAAUAACUUUAUUUCCAAA | 1040 | 5515-5537 |
| AD-1637870 | UGGAAAUAAAGUUAUUACUCA | 166 | 5517-5537 | UGAGTAAUAACUUUAUUUCCAAA | 1041 | 5515-5537 |
| AD-1637871 | UGGAAAUAAAGUUAUUACUCA | 167 | 5517-5537 | UGAGTAAUAACUUUAUUUCCAGG | 1042 | 5515-5537 |
| AD-1637872 | UGGAAAUAAAGUUAUUACUCA | 168 | 5517-5537 | UGAGTAAUAACTUUAUUUCCAGG | 1043 | 5515-5537 |
| AD-1637873 | UGGAAAUAAAGUUAUUACUCA | 169 | 5517-5537 | UGAGTAAUAACTUUATUUCCAGG | 1044 | 5515-5537 |
| AD-1637874 | UGGAAAUAAAGUUAUUACUCA | 170 | 5517-5537 | UGAGTAAUAACTUUAUUUCCAGG | 1045 | 5515-5537 |
| AD-1637875 | UGGAUAUAAAGUUAUUACUCA | 171 | 5517-5537 | UGAGTAAUAACTUUAUAUCCAGG | 1046 | 5515-5537 |
| AD-1637876 | UGGUAAUAAAGUUAUUACUCA | 172 | 5517-5537 | UGAGTAAUAACTUUAUUACCAGG | 1047 | 5515-5537 |
| AD-1637877 | UGCAAAUAAAGUUAUUACUCA | 173 | 5517-5537 | UGAGTAAUAACTUUAUUUGCAGG | 1048 | 5515-5537 |

TABLE 3-continued

Unmodified Sense and Antisense Strand Sequences of MAPT dsRNA Agents

| Duplex Name | Sense Sequence 5' to 3' | SEQ ID NO: | Range in NM_016841.4 | Antisense Sequence 5' to 3' | SEQ ID NO: | Range in NM_016841.4 |
|---|---|---|---|---|---|---|
| AD-1637878 | CGCAUGGUCAGUAAAAGCAAA | 174 | 524-544 | UUUGCUUUUACUGACCAUGCGAG | 1049 | 522-544 |
| AD-1637879 | CGCAUGGUCAGUAAAAGCAAA | 175 | 524-544 | UUUGCUTUUACUGACCAUGCGAG | 1050 | 522-544 |
| AD-1637880 | CGCAUGGUCAGUAAAAGCAAA | 176 | 524-544 | UUUGCUTUUACUGACCAUGCGGG | 1051 | 522-544 |
| AD-1637881 | CGCAUGGUCAGUAAAAGCAAA | 177 | 524-544 | UUUGCUTUUACTGACCAUGCGGG | 1052 | 522-544 |
| AD-1637882 | CGCAUGGUCAGUAAAAGCAAA | 178 | 524-544 | UUUGCUTUUACTGACCAUGCGGG | 1053 | 522-544 |
| AD-1637883 | CGCAUGGUCAGUAAAAGCAAA | 179 | 524-544 | UTUGCUTUUACTGACCAUGCGGG | 1054 | 522-544 |
| AD-1637884 | CGCAUGGUCAGUAAAAGCAAA | 180 | 524-544 | UTUGCUTUUACTGACCAUGCGGG | 1055 | 522-544 |
| AD-1637885 | CAUGGUCAGUAAAAGCAAA | 181 | 526-544 | UUUGCUTUUACUGACCAUGCG | 1056 | 524-544 |
| AD-1637886 | CAUGGUCAGUAAAAGCAAA | 182 | 526-544 | UTUGCUTUUACTGACCAUGCG | 1057 | 524-544 |
| AD-1637887 | CAUGGUCAGUAAAAGCAAA | 183 | 526-544 | UTUGCUTUUACTGACCAUGCG | 1058 | 524-544 |
| AD-1637888 | CGCAUGGUCAGUAAAAGCAAA | 184 | 524-544 | UUUGCUTUUACUGACCAUGCGAG | 1059 | 522-544 |
| AD-1637889 | CGCAAGGUCAGUAAAAGCAAA | 185 | 524-544 | UUUGCUTUUACUGACCUUGCGAG | 1060 | 522-544 |
| AD-1637890 | CGCUUGGUCAGUAAAAGCAAA | 186 | 524-544 | UUUGCUTUUACUGACCAAGCGAG | 1061 | 522-544 |
| AD-1637891 | CGGAUGGUCAGUAAAAGCAAA | 187 | 524-544 | UUUGCUTUUACUGACCAUCCGAG | 1062 | 522-544 |
| AD-1637892 | GGUCACGUGACCCAAGCUCGA | 188 | 506-526 | UCGAGCTUGGGUCACGUGACCAG | 1063 | 504-526 |
| AD-1637893 | GUCACGUGACCCAAGCUCGCA | 189 | 507-527 | UGCGAGCUUGGGUCACGUGACCA | 1064 | 505-527 |
| AD-1637894 | UCACGUGACCCAAGCUCGCAA | 190 | 508-528 | UUGCGAGCUUGGGUCACGUGACC | 1065 | 506-528 |
| AD-1637895 | CACGUGACCCAAGCUCGCAUA | 191 | 509-529 | UAUGCGAGCUUGGGUCACGUGAC | 1066 | 507-529 |
| AD-1637896 | CACGUGACCCAAGCUCGCAUA | 192 | 509-529 | UAUGCGAGCUUGGGUCACGUGAC | 1067 | 507-529 |
| AD-1637897 | ACGUGACCCAAGCUCGCAUGA | 193 | 510-530 | UCAUGCGAGCUUGGGUCACGUGA | 1068 | 508-530 |
| AD-1637898 | CGUGACCCAAGCUCGCAUGGA | 194 | 511-531 | UCCATGCGAGCUUGGGUCACGUG | 1069 | 509-531 |
| AD-1637899 | GUGACCCAAGCUCGCAUGGUA | 195 | 512-532 | UACCAUGCGAGCUUGGGUCACGU | 1070 | 510-532 |
| AD-1637900 | UGACCCAAGCUCGCAUGGUCA | 196 | 513-533 | UGACCATGCGAGCUUGGGUCACG | 1071 | 511-533 |
| AD-1637901 | GACCCAAGCUCGCAUGGUCAA | 197 | 514-534 | UUGACCAUGCGAGCUUGGGUCAC | 1072 | 512-534 |

TABLE 3-continued

Unmodified Sense and Antisense Strand Sequences of MAPT dsRNA Agents

| Duplex Name | Sense Sequence 5' to 3' | SEQ ID NO: | Range in NM_016841.4 | Antisense Sequence 5' to 3' | SEQ ID NO: | Range in NM_016841.4 |
|---|---|---|---|---|---|---|
| AD-1637902 | ACCCAAGCUCGCAUGGUCAGA | 198 | 515-535 | UCUGACCAUGCGAGCUUGGGUCA | 1073 | 513-535 |
| AD-1637903 | CCCAAGCUCGCAUGGUCAGUA | 199 | 516-536 | UACUGACCAUGCGAGCUUGGGUC | 1074 | 514-536 |
| AD-1637904 | CCAAGCUCGCAUGGUCAGUAA | 200 | 517-537 | UUACTGACCAUGCGAGCUUGGGU | 1075 | 515-537 |
| AD-1637905 | CAAGCUCGCAUGGUCAGUAAA | 201 | 518-538 | UUUACUGACCAUGCGAGCUUGGG | 1076 | 516-538 |
| AD-1637906 | AAGCUCGCAUGGUCAGUAAAA | 202 | 519-539 | UUUUACTGACCAUGCGAGCUUGG | 1077 | 517-539 |
| AD-1637907 | AGCUCGCAUGGUCAGUAAAAA | 203 | 520-540 | UUUUTACUGACCAUGCGAGCUUG | 1078 | 518-540 |
| AD-1637908 | CUCGCAUGGUCAGUAAAAGCA | 204 | 522-542 | UGCUTUTACUGACCAUGCGAGCU | 1079 | 520-542 |
| AD-1637909 | UCGCAUGGUCAGUAAAAGCAA | 205 | 523-543 | UUGCTUTUACUGACCAUGCGAGC | 1080 | 521-543 |
| AD-1637910 | CGCAUGGUCAGUAAAAGCAAA | 206 | 524-544 | UUUGCUTUUACUGACCAUGCGAG | 1081 | 522-544 |
| AD-1637911 | GCAUGGUCAGUAAAAGCAAAA | 207 | 525-545 | UUUUGCTUUUACUGACCAUGCGA | 1082 | 523-545 |
| AD-1637912 | CAUGGUCAGUAAAAGCAAAGA | 208 | 526-546 | UCUUTGCUUUUACUGACCAUGCG | 1083 | 524-546 |
| AD-1637913 | AUGGUCAGUAAAAGCAAAGAA | 209 | 527-547 | UUCUTUGCUUUUACUGACCAUGC | 1084 | 525-547 |
| AD-1637914 | UGGUCAGUAAAAGCAAAGACA | 210 | 528-548 | UGUCTUTGCUUUUACUGACCAUG | 1085 | 526-548 |
| AD-1637915 | GGUCAGUAAAAGCAAAGACGA | 211 | 529-549 | UCGUCUTUGCUUUUACUGACCAU | 1086 | 527-549 |
| AD-1637916 | GUCAGUAAAAGCAAAGACGGA | 212 | 530-550 | UCCGTCTUUGCUUUUACUGACCA | 1087 | 528-550 |
| AD-1637917 | AGUAAAAGCAAAGACGGGACA | 213 | 533-553 | UGUCCCGUCUUTGCUUUUACUGA | 1088 | 531-553 |
| AD-1637918 | AGUAAAAGCAAAGACGGGACA | 214 | 533-553 | UGUCCCGUCUUUGCUUUUACUGA | 1089 | 531-553 |
| AD-1637919 | GUGUGCAAAUAGUCUACAAAA | 215 | 969-989 | UUUUGUAGACUAUUUGCACACUG | 1090 | 967-989 |
| AD-1637920 | UGUGCAAAUAGUCUACAAACA | 216 | 970-990 | UGUUTGTAGACUAUUUGCACACU | 1091 | 968-990 |
| AD-1637921 | GUGCAAAUAGUCUACAAACCA | 217 | 971-991 | UGGUTUGUAGACUAUUUGCACAC | 388 | 969-991 |
| AD-1637922 | UGCAAAUAGUCUACAAACCAA | 218 | 972-992 | UUGGTUTGUAGACUAUUUGCACA | 389 | 970-992 |
| AD-1637923 | GCAAAUAGUCUACAAACCAGA | 219 | 973-993 | UCUGGUTUGUAGACUAUUUGCAC | 390 | 971-993 |
| AD-1637924 | CAAAUAGUCUACAAACCAGUA | 220 | 974-994 | UACUGGTUUGUAGACUAUUUGCA | 391 | 972-994 |
| AD-1637925 | AAUAGUCUACAAACCAGUUGA | 221 | 976-996 | UCAACUGGUUUGUAGACUAUUUG | 392 | 974-996 |

TABLE 3-continued

Unmodified Sense and Antisense Strand Sequences of MAPT dsRNA Agents

| Duplex Name | Sense Sequence 5' to 3' | SEQ ID NO: | Range in NM_016841.4 | Antisense Sequence 5' to 3' | SEQ ID NO: | Range in NM_016841.4 |
|---|---|---|---|---|---|---|
| AD-1637926 | AUAGUCUACAAACCAGUUGAA | 222 | 977-997 | UUCAACTGGUUUGUAGACUAUUU | 393 | 975-997 |
| AD-1637927 | UAGUCUACAAACCAGUUGACA | 223 | 978-998 | UGUCAACUGGUUUGUAGACUAUU | 394 | 976-998 |
| AD-1637928 | AGUCUACAAACCAGUUGACCA | 224 | 979-999 | UGGUCAACUGGUUUGUAGACUAU | 395 | 977-999 |
| AD-1637929 | GUCUACAAACCAGUUGACCUA | 225 | 980-1000 | UAGGTCAACUGGUUUGUAGACUA | 396 | 978-1000 |
| AD 1637930 | UCUACAAACCAGUUGACCUGA | 226 | 981-1001 | UCAGGUCAACUGGUUUGUAGACU | 397 | 979-1001 |
| AD-1637931 | CUACAAACCAGUUGACCUGAA | 227 | 982-1002 | UUCAGGTCAACUGGUUUGUAGAC | 398 | 980-1002 |
| AD-1637932 | UACAAACCAGUUGACCUGAGA | 228 | 983-1003 | UCUCAGGUCAACUGGUUUGUAGA | 399 | 981-1003 |
| AD-1637933 | ACAAACCAGUUGACCUGAGCA | 229 | 984-1004 | UGCUCAGGUCAACUGGUUUGUAG | 400 | 982-1004 |
| AD-1637934 | CAAACCAGUUGACCUGAGCAA | 230 | 985-1005 | UUGCTCAGGUCAACUGGUUUGUA | 401 | 983-1005 |
| AD-1637935 | AAACCAGUUGACCUGAGCAAA | 231 | 1986-1006 | UUUGCUCAGGUCAACUGGUUUGU | 402 | 984-1006 |
| AD-1637936 | AACCAGUUGACCUGAGCAAGA | 232 | 987-1007 | UCUUGCTCAGGUCAACUGGUUUG | 403 | 985-1007 |
| AD-1637937 | ACCAGUUGACCUGAGCAAGGA | 233 | 988-1008 | UCCUTGCUCAGGUCAACUGGUUU | 404 | 986-1008 |
| AD-1637938 | CCAGUUGACCUGAGCAAGGUA | 234 | 989-1009 | UACCUTGCUCAGGUCAACUGGUU | 405 | 987-1009 |
| AD-1637939 | CAGUUGACCUGAGCAAGGUGA | 235 | 990-1010 | UCACCUTGCUCAGGUCAACUGGU | 406 | 988-1010 |
| AD-1637940 | AGUAAAAUCUGAGAAGCUUGA | 236 | 1069-1089 | UCAAGCTUCUCAGAUUUUACUUC | 407 | 1067-1089 |
| AD-1637941 | GUAAAAUCUGAGAAGCUUGAA | 237 | 1070-1090 | UUCAAGCUUCUCAGAUUUUACUU | 408 | 1068-1090 |
| AD-1637942 | UAAAAUCUGAGAAGCUUGACA | 238 | 1071-1091 | UGUCAAGCUUCUCAGAUUUUACU | 409 | 1069-1091 |
| AD-1637943 | AAAAUCUGAGAAGCUUGACUA | 239 | 1072-1092 | UAGUCAAGCUUCUCAGAUUUUAC | 410 | 1070-1092 |
| AD-1637944 | AAAUCUGAGAAGCUUGACUUA | 240 | 1073-1093 | UAAGTCAAGCUUCUCAGAUUUUA | 411 | 1071-1093 |
| AD-1637945 | AAUCUGAGAAGCUUGACUUCA | 241 | 1074-1094 | UGAAGUCAAGCUUCUCAGAUUUU | 412 | 1072-1094 |
| AD-1637946 | AUCUGAGAAGCUUGACUUCAA | 242 | 1075-1095 | UUGAAGTCAAGCUUCUCAGAUUU | 413 | 1073-1095 |
| AD-1637947 | UCUGAGAAGCUUGACUUCAAA | 243 | 1076-1096 | UUUGAAGUCAAGCUUCUCAGAUU | 414 | 1074-1096 |
| AD-1637948 | CUGAGAAGCUUGACUUCAAGA | 244 | 1077-1097 | UCUUGAAGUCAAGCUUCUCAGAU | 415 | 1075-1097 |
| AD-1637949 | UGAGAAGCUUGACUUCAAGGA | 245 | 1078-1098 | UCCUTGAAGUCAAGCUUCUCAGA | 416 | 1076-1098 |

TABLE 3-continued

Unmodified Sense and Antisense Strand Sequences of MAPT dsRNA Agents

| Duplex Name | Sense Sequence 5' to 3' | SEQ ID NO: | Range in NM_016841.4 | Antisense Sequence 5' to 3' | SEQ ID NO: | Range in NM_016841.4 |
|---|---|---|---|---|---|---|
| AD-1637950 | GAGAAGCUUGACUUCAAGGAA | 246 | 1079-1099 | UUCCUUGAAGUCAAGCUUCUCAG | 417 | 1077-1099 |
| AD-1637951 | AGAAGCUUGACUUCAAGGACA | 247 | 1080-1100 | UGUCCUUGAAGUCAAGCUUCUCA | 418 | 1078-1100 |
| AD-1637952 | GAAGCUUGACUUCAAGGACAA | 248 | 1081-1101 | UUGUCCUUGAAGUCAAGCUUCUC | 419 | 1079-1101 |
| AD-1637953 | UUUGGAAAUAAAGUUAUUACA | 249 | 5515-5535 | UGUAAUAACUUTAUUUCCAAAUU | 420 | 5513-5535 |
| AD-1637954 | UUGGAAAUAAAGUUAUUACUA | 250 | 5516-5536 | UAGUAATAACUUTAUUUCCAAAU | 421 | 5514-5536 |
| AD-1637955 | UUGGAAAUAAAGUUAUUACUA | 251 | 5516-5536 | UAGUAATAACUUUAUUUCCAAAU | 422 | 5514-5536 |
| AD-1637956 | UGGAAAUAAAGUUAUUACUCA | 252 | 5517-5537 | UGAGTAAUAACUUAUUUCCAAA | 423 | 5515-5537 |
| AD-1637957 | GAAAUAAAGUUAUUACUCUGA | 253 | 5519-5539 | UCAGAGTAAUAACUUUAUUUCCA | 424 | 5517-5539 |
| AD-1637958 | AAAUAAAGUUAUUACUCUGAA | 254 | 5520-5540 | UUCAGAGUAAUAACUUUAUUUCC | 425 | 5518-5540 |
| AD-1637959 | AAUAAAGUUAUUACUCUGAUA | 255 | 5521-5541 | UAUCAGAGUAAUAACUUUAUUUC | 426 | 5519-5541 |
| AD-1637960 | AUAAAGUUAUUACUCUGAUUA | 256 | 5522-5542 | UAAUCAGAGUAAUAACUUUAUUU | 427 | 5520-5542 |
| AD-397167 | UGGAAAUAAAGUUAUUACUCA | 257 | 5517-5537 | UGAGUAAUAACUUUAUUUCCAAA | 428 | 5515-5537 |
| AD-523565 | CGCAUGGUCAGUAAAAGCAAA | 258 | 524-544 | UUUGCUUUUACUGACCAUGCGAG | 429 | 522-544 |

TABLE 4

Modified Sense and Antisense Strand Sequences of MAPT dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1397070 | ascsgug(Ahd)ccCfAfAfgcucgcaugaL96 | 430 | VPusdCsaudGcdGagcudTgGfgucacgusgsa | 588 | UCACGUGACCCAAGCUCGCAUGG | 746 |
| AD-1397072 | gsusgac(Chd)caAfGfCfucgcaugguaL96 | 431 | VPusAfsccdAu(G2p)cgagcuUfgGfgucacsgsu | 589 | ACGUGACCCAAGCUCGCAUGGUC | 747 |
| AD-1397073 | usgsacc(Chd)aaGfCfUfcgcauggucaL96 | 432 | VPusdGsacdCadTgcgadGcUfugggucascsg | 590 | CGUGACCCAAGCUCGCAUGGUCA | 748 |
| AD-1397075 | ascscca(Ahd)gcUfCfGfcauggucagaL96 | 433 | VPusdCsugdAcdCaugcdGaGfcuuggguscsa | 591 | UGACCCAAGCUCGCAUGGUCAGU | 749 |
| AD-1397081 | asusagu(Chd)uaCfAfAfaccaguugaaL96 | 434 | VPusUfscadAc(Tgn)gguugUfaGfacuaususu | 592 | AAAUAGUCUACAAACCAGUUGAC | 750 |
| AD-1397083 | gsuscua(Chd)aaAfCfCfaguugaccuaL96 | 435 | VPusAfsggdTc(Agn)acugguUfuGfuagacsusa | 593 | UAGUCUACAAACCAGUUGACCUG | 751 |
| AD-1397088 | asuscug(Ahd)gaAfGfCfuugacuucaaL96 | 436 | VPusUfsgadAg(Tgn)caagcuUfcUfcagaususu | 594 | AAAUCUGAGAAGCUUGACUUCAA | 752 |
| AD-1397249 | gsasaau(Ahd)aaGfUfUfauuacucugaL96 | 437 | VPusdCsagdAgdTaauadAcUfuuauuucscsa | 595 | UGGAAAUAAAGUUAUUACUCUGA | 753 |

TABLE 4-continued

Modified Sense and Antisense Strand Sequences of MAPT dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1397252 | gscsucg(Chd)auGfGf UfcaguaaaagaL96 | 438 | VPusdCsuudTudAcuga dCcAfugcgagcsusu | 596 | AAGCUCGCAUGGUCA GUAAAAGC | 754 |
| AD-1397253 | csuscgc(Ahd)ugGfUf CfaguaaaagcaL96 | 439 | VPusdGscudTudTacug dAcCfaugcgagscsu | 597 | AGCUCGCAUGGUCAG UAAAAGCA | 755 |
| AD-1397258 | asusggu(Chd)agUfAf AfaagcaaagaaL96 | 440 | VPusUfscudTu(G2p)cu uuuaCfuGfaccausgsc | 598 | GCAUGGUCAGUAAAA GCAAAGAC | 756 |
| AD-1397261 | gsuscag(Uhd)aaAfAf GfcaaagacggaL96 | 441 | VPusdCscgdTcdTuugcd TuUfuacugacscsa | 599 | UGGUCAGUAAAAGCA AAGACGGG | 757 |
| AD-1397262 | uscsagu(Ahd)aaAfGf CfaaagacgggaL96 | 442 | VPusdCsccdGudCuuug dCuUfuuacugascsc | 600 | GGUCAGUAAAAGCAA AGACGGGA | 758 |
| AD-1397263 | csasgua(Ahd)aaGfCf AfaagacgggaaL96 | 443 | VPusdTsccdCgdTcuuud GcUfuuuacugsasc | 601 | GUCAGUAAAAGCAAA GACGGGAC | 759 |
| AD-1397291 | gscsaaa(Uhd)agUfCf UfacaaaccagaL96 | 444 | VPusdCsugdGudTugua dGaCfuauuugcsasc | 602 | GUGCAAAUAGUCUAC AAACCAGU | 760 |
| AD-1397293 | asasaua(Ghd)ucUfAf CfaaaccaguuaL96 | 445 | VPusAfsacdTg(G2p)uu uguaGfaCfuauuusgsc | 603 | GCAAAUAGUCUACAA ACCAGUUG | 761 |
| AD-1397294 | asasuag(Uhd)cuAfCf AfaaccaguugaL96 | 446 | VPusdCsaadCudGguuu dGuAfgacuauususg | 604 | CAAAUAGUCUACAAA CCAGUUGA | 762 |
| AD-1397295 | usasguc(Uhd)acAfAf AfccaguugacaL96 | 447 | VPusdGsucdAadCuggu dTuGfuagacuasusu | 605 | AAUAGUCUACAAACC AGUUGACC | 763 |
| AD-1397298 | usascaa(Ahd)ccAfGf UfugaccugagaL96 | 448 | VPusCfsucdAg(G2p)uc aacuGfgUfuuguasgsa | 606 | UCUACAAACCAGUUG ACCUGAGC | 764 |
| AD-1397299 | ascsaaa(Chd)caGfUf UfgaccugagcaL96 | 449 | VPusGfscudCa(G2p)gu caacUfgGfuuugusasg | 607 | CUACAAACCAGUUGA CCUGAGCA | 765 |
| AD-1637732 | usgsaau(Uhd)ugGfAf AfauaaaguuaaL96 | 450 | VPusdTsaadCudTuaud TcCfaaauucascsu | 608 | AGUGAAUUUGGAAAU AAAGUUAU | 766 |
| AD-1637733 | usgsaau(Uhd)UfgGf AfAfauaaaguuaaL96 | 451 | VPusUfsaadCu(Tgn)ua uuucCfaAfauucascsu | 609 | AGUGAAUUUGGAAAU AAAGUUAU | 767 |
| AD-1637734 | gsasauu(Uhd)GfgAf AfAfuaaaguuauaL96 | 452 | VPusAfsuadAc(Tgn)uu auuuCfcAfaauucsasc | 610 | GUGAAUUUGGAAAUA AAGUUAUU | 768 |
| AD-1637735 | asasuu(Uhd)ggaAfAf UfaaaguuauuaL96 | 453 | VPusdAsaudAadCuuua dTuUfccaaauuscsa | 611 | UGAAUUUGGAAAUAA AGUUAUUA | 769 |
| AD-1637736 | asusuugg(Ahd)aAfUf AfaaguuauuaaL96 | 454 | VPusdTsaadTadAcuuud AuUfuccaaausus c | 612 | GAAUUUGGAAAUAAA GUUAUUAC | 770 |
| AD-1637737 | asusuugg(Ahd)aAfUf AfaaguuauuaaL96 | 455 | VPusUfsaadTa(Agn)cu uuauUfuCfcaaausus c | 613 | GAAUUUGGAAAUAAA GUUAUUAC | 771 |
| AD-1637739 | gsgsaaa(Uhd)aaAfGf UfuauuacucuaL96 | 456 | VPusdAsgadGudAauaa dCuUfuauuuccsasa | 614 | UUGGAAAUAAAGUUA UUACUCUG | 772 |
| AD-1637744 | usasaag(Uhd)UfaUf UfAfcucugauuaaL96 | 457 | VPusUfsaadTc(Agn)ga guaaUfaAfcuuuasusu | 615 | AAUAAAGUUAUUACU CUGAUUAA | 773 |
| AD-1637745 | gsusgac(Chd)caAfGf CfucgcauggaL96 | 458 | VPusAfsccdAu(G2p)cg agdCuUfgGfgucacsgsu | 616 | ACGUGACCCAAGCUC GCAUGGUC | 774 |
| AD-1637746 | gsusgac(Chd)caAfgC fUfcgcaugguaL96 | 459 | VPusAfsccdAu(G2p)cg agdCuUfgGfgucacsgsu | 617 | ACGUGACCCAAGCUC GCAUGGUC | 775 |
| AD-1637747 | gsusgac(Chd)caAfgd CUfcgcaugguaL96 | 460 | VPusAfsccdAu(G2p)cg agdCuUfgGfgucacsgsu | 618 | ACGUGACCCAAGCUC GCAUGGUC | 776 |
| AD-1637748 | gsusgac(Chd)caAfgC fdTcgcaugguaL96 | 461 | VPusAfsccdAu(G2p)cg agdCuUfgGfgucacsgsu | 619 | ACGUGACCCAAGCUC GCAUGGUC | 777 |

TABLE 4-continued

Modified Sense and Antisense Strand Sequences of MAPT dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1637749 | gsusgac(Chd)caAfGf CfucgcaugguaL96 | 462 | VPusAfsccdAu(G2p)cg agdCuUfgdGgucacsgsu | 620 | ACGUGACCCAAGCUC GCAUGGUC | 778 |
| AD-1637750 | gsusgac(Chd)caAfGf CfucgcaugguaL96 | 463 | VPusdAsccdAu(G2p)cg agdCuUfgdGgucacsgsu | 621 | ACGUGACCCAAGCUC GCAUGGUC | 779 |
| AD-1637751 | gsusgag(Chd)caAfGf CfucgcaugguaL96 | 464 | VPusAfsccdAu(G2p)cg agcuUfgGfcucacsgsu | 622 | ACGUGACCCAAGCUC GCAUGGUC | 780 |
| AD-1637752 | gsusgaa(Chd)caAfGf CfucgcaugguaL96 | 465 | VPusAfsccdAu(G2p)cg agcuUfgGfuucacsgsu | 623 | ACGUGACCCAAGCUC GCAUGGUC | 781 |
| AD-1637753 | gsusguc(Chd)caAfGf CfucgcaugguaL96 | 466 | VPusAfsccdAu(G2p)cg agcuUfgGfgacacsgsu | 624 | ACGUGACCCAAGCUC GCAUGGUC | 782 |
| AD-1637754 | gsuscac(Chd)caAfGf CfucgcaugguaL96 | 467 | VPusAfsccdAu(G2p)cg agcuUfgGfgugacsgsu | 625 | ACGUGACCCAAGCUC GCAUGGUC | 783 |
| AD-1637755 | gsusuac(Chd)caAfGf CfucgcaugguaL96 | 468 | VPusAfsccdAu(G2p)cg agcuUfgGfguaacsgsu | 626 | ACGUGACCCAAGCUC GCAUGGUC | 784 |
| AD-1637756 | gsusgac(Chd)caAfGf CfucgcaugguaL96 | 469 | VPusAfscdCa(Tgn)gcg agcuUfgGfgucacsgsu | 627 | ACGUGACCCAAGCUC GCAUGGUC | 785 |
| AD-1637757 | gsusgac(Chd)caAfGf CfucgcaugguaL96 | 470 | VPusAfscdCa(Tgn)gcg agdCuUfgGfgucacsgsu | 628 | ACGUGACCCAAGCUC GCAUGGUC | 786 |
| AD-1637758 | gsusgac(Chd)caAfGf CfucgcaugguaL96 | 471 | VPusAfscdCa(Tgn)gcg agdCuUfgdGgucacsgsu | 629 | ACGUGACCCAAGCUC GCAUGGUC | 787 |
| AD-1637759 | gsusgac(Chd)caAfGf CfucgcaugguaL96 | 472 | VPusdAscdCa(Tgn)gcg agdCuUfgdGgucacsgsu | 630 | ACGUGACCCAAGCUC GCAUGGUC | 788 |
| AD-1637760 | gsusgac(Chd)caAfGf CfucgcaugguaL96 | 473 | VPusAfsccdAudGcgagc uUfgGfgucacsgsu | 631 | ACGUGACCCAAGCUC GCAUGGUC | 789 |
| AD-1637761 | gsusgac(Chd)caAfGf CfucgcuugguaL96 | 474 | VPusAfsccdAadGcgagc uUfgGfgucacsgsu | 632 | ACGUGACCCAAGCUC GCAUGGUC | 790 |
| AD-1637762 | gsusgac(Chd)caAfGf CfucguaugguaL96 | 475 | VPusAfsccdAudAcgagc uUfgGfgucacsgsu | 633 | ACGUGACCCAAGCUC GCAUGGUC | 791 |
| AD-1637763 | gsusgac(Chd)caAfGf CfucgcaugguaL96 | 476 | VPusdAsccdAudGcgag dCuUfgggucacsgsu | 634 | ACGUGACCCAAGCUC GCAUGGUC | 792 |
| AD-1637764 | gsusgac(Chd)caAfGf CfucgcuugguaL96 | 477 | VPusdAsccdAadGcgag dCuUfgggucacsgsu | 635 | ACGUGACCCAAGCUC GCAUGGUC | 793 |
| AD-1637765 | gsusgac(Chd)caAfGf CfucguaugguaL96 | 478 | VPusdAsccdAudAcgag dCuUfgggucacsgsu | 636 | ACGUGACCCAAGCUC GCAUGGUC | 794 |
| AD-1637766 | usascaa(Ahd)ccAfGf UfugaccugagaL96 | 479 | VPusdCsucdAg(G2p)uc aadCuGfguuuguasgsg | 637 | UCUACAAACCAGUUG ACCUGAGC | 795 |
| AD-1637767 | usascaa(Ahd)ccAfGf UfugaccugagaL96 | 480 | VPusCfsucdAg(G2p)uc aadCuGfgdTuuguasgsg | 638 | UCUACAAACCAGUUG ACCUGAGC | 796 |
| AD-1637768 | usascaa(Ahd)ccAfGf UfugaccugagaL96 | 481 | VPusdCsucdAg(G2p)uc aadCuGfgdTuuguasgsg | 639 | UCUACAAACCAGUUG ACCUGAGC | 797 |
| AD-1637769 | usascaa(Ahd)ccAfGf UfugaccugagaL96 | 482 | VPusdCsucdAg(G2p)uc aadCudGgdTuuguasgsg | 640 | UCUACAAACCAGUUG ACCUGAGC | 798 |
| AD-1637770 | usascaa(Ahd)ccAfgU fUfgaccugagaL96 | 483 | VPusCfsucdAg(G2p)uc aadCuGfgUfuuguasgsa | 641 | UCUACAAACCAGUUG ACCUGAGC | 799 |
| AD-1637771 | usascaa(Ahd)ccAfGf UfugaccugagaL96 | 484 | VPusCfsucadGg(Tgn)c aacuGfgUfuuguasgsg | 642 | UCUACAAACCAGUUG ACCUGAGC | 800 |
| AD-1637772 | usascaa(Ahd)ccAfGf UfugaccugagaL96 | 485 | VPusCfsucadGg(Tgn)c aadCuGfgdTuuguasgsg | 643 | UCUACAAACCAGUUG ACCUGAGC | 801 |

TABLE 4-continued

Modified Sense and Antisense Strand Sequences of MAPT dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1637773 | usascaa(Ahd)ccAfGf UfugaccugagaL96 | 486 | VPusdCsucadGg(Tgn)c aadCudGgdTuuguasgsg | 644 | UCUACAAACCAGUUG ACCUGAGC | 802 |
| AD-1637774 | usascaa(Ahd)ccAfGf UfugaccugagaL96 | 487 | VPusCfsucdAgdGucaac uGfgUfuuguasgsg | 645 | UCUACAAACCAGUUG ACCUGAGC | 803 |
| AD-1637775 | usascaa(Ahd)ccAfGf UfugacgugagaL96 | 488 | VPusCfsucdAcdGucaac uGfgUfuuguasgsg | 646 | UCUACAAACCAGUUG ACCUGAGC | 804 |
| AD-1637776 | usascaa(Ahd)ccAfGf UfugacuugagaL96 | 489 | VPusCfsucdAadGucaac uGfgUfuuguasgsg | 647 | UCUACAAACCAGUUG ACCUGAGC | 805 |
| AD-1637777 | usascaa(Ahd)ccAfGf UfugaucugagaL96 | 490 | VPusCfsucdAgdAucaac uGfgUfuuguasgsg | 648 | UCUACAAACCAGUUG ACCUGAGC | 806 |
| AD-1637778 | usascaa(Ahd)ccAfGf UfugacgugagaL96 | 491 | VPusdCsucdAcdGucaa dCuGfguuuguasgsg | 649 | UCUACAAACCAGUUG ACCUGAGC | 807 |
| AD-1637779 | usascaa(Ahd)ccAfGf UfugacuugagaL96 | 492 | VPusdCsucdAadGucaa dCuGfguuuguasgsg | 650 | UCUACAAACCAGUUG ACCUGAGC | 808 |
| AD-1637780 | usascaa(Ahd)ccAfGf UfugaucugagaL96 | 493 | VPusdCsucdAgdAucaa dCuGfguuuguasgsg | 651 | UCUACAAACCAGUUG ACCUGAGC | 809 |
| AD-1637781 | csasa(Ahd)ccAfGfUf ugaccugagaL96 | 494 | VPusCfsucdAg(G2p)uc aacuGfgUfuugsusg | 652 | UACAAACCAGUUGAC CUGAGC | 810 |
| AD-1637782 | csasa(Ahd)ccAfGfUf lugaccugagaL96 | 495 | VPusdCsucdAg(G2p)uc aadCuGfguuugsusg | 653 | UACAAACCAGUUGAC CUGAGC | 811 |
| AD-1637783 | gsuscua(Chd)aaAfCf CfaguugaccuaL96 | 496 | VPusAfsggdTc(Agn)ac ugguUfuGfuagacsusg | 654 | UAGUCUACAAACCAG UUGACCUG | 812 |
| AD-1637784 | gsuscua(Chd)aaAfCf CfaguugaccuaL96 | 497 | VPusAfsggUfc(Agn)ac ugguUfuGfuagacsusg | 655 | UAGUCUACAAACCAG UUGACCUG | 813 |
| AD-1637785 | gsuscuu(Chd)aaAfCf CfaguugaccuaL96 | 498 | VPusAfsggdTc(Agn)ac ugguUfuGfaagacsusg | 656 | UAGUCUACAAACCAG UUGACCUG | 814 |
| AD-1637786 | gsuscaa(Chd)aaAfCf CfaguugaccuaL96 | 499 | VPusAfsggdTc(Agn)ac ugguUfuGfuugacsusg | 657 | UAGUCUACAAACCAG UUGACCUG | 815 |
| AD-1637787 | gsusgua(Chd)aaAfCf CfaguugaccuaL96 | 500 | VPusAfsggdTc(Agn)ac ugguUfuGfuacacsusg | 658 | UAGUCUACAAACCAG UUGACCUG | 816 |
| AD-1637788 | gsuscua(Chd)aaAfCf CfaguugaccuaL96 | 501 | VPusdAsggdTcdAacug dGuUfuguagacsusg | 659 | UAGUCUACAAACCAG UUGACCUG | 817 |
| AD-1637789 | gsuscua(Chd)aaAfCf CfaguugaccuaL96 | 502 | VPusdAsggdTc(Agn)ac ugdGuUfuguagacsusg | 660 | UAGUCUACAAACCAG UUGACCUG | 818 |
| AD-1637790 | gsuscua(Chd)aaAfCf CfaguuuaccuaL96 | 503 | VPusAfsggdTadAacugg uUfuGfuagacsusg | 661 | UAGUCUACAAACCAG UUGACCUG | 819 |
| AD-1637791 | gsuscua(Chd)aaAfCf CfaguuuaccuaL96 | 504 | VPusdAsggdTadAacug dGuUfuguagacsusg | 662 | UAGUCUACAAACCAG UUGACCUG | 820 |
| AD-1637792 | asusagu(Chd)uaCfAf AfaccaguugaaL96 | 505 | VPusUfscadAc(Tgn)gg uuugUfadGacuausu | 663 | AAAUAGUCUACAAAC CAGUUGAC | 821 |
| AD-1637793 | asusagu(Chd)uaCfAf AfaccaguugaaL96 | 506 | VPusUfscadAc(Tgn)gg uudTgUfadGacuausu | 664 | AAAUAGUCUACAAAC CAGUUGAC | 822 |
| AD-1637794 | asusagu(Chd)uaCfAf AfaccaguugaaL96 | 507 | VPusUfscadAc(Tgn)gg uudTgUfaGfacuausu | 665 | AAAUAGUCUACAAAC CAGUUGAC | 823 |
| AD-1637795 | asusagu(Chd)uaCfAf AfaccaguugaaL96 | 508 | VPusdTscadAc(Tgn)gg uudTgUfagacuausu | 666 | AAAUAGUCUACAAAC CAGUUGAC | 824 |

TABLE 4-continued

Modified Sense and Antisense Strand Sequences of MAPT dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1637796 | asusagu(Chd)uaCfAf AfaccaguugaaL96 | 509 | VPusdTscadAc(Tgn)gg uudTgUfadGacuauscsu | 667 | AAAUAGUCUACAAAC CAGUUGAC | 825 |
| AD-1637797 | usasgu(Chd)uaCfAf AfaccaguugaaL96 | 510 | VPusUfscadAc(Tgn)gg uudTgUfadGacuasusc | 668 | AAUAGUCUACAAACC AGUUGAC | 826 |
| AD-1637798 | asgsu(Chd)uaCfAfAf accaguugaaL96 | 511 | VPusUfscadAc(Tgn)gg uudTgUfadGacusgsu | 669 | AUAGUCUACAAACCA GUUGAC | 827 |
| AD-1637799 | asusaga(Chd)uaCfAf AfaccaguugaaL96 | 512 | VPusdTscadAc(Tgn)gg uudTgUfadGucuauscsu | 670 | AAAUAGUCUACAAAC CAGUUGAC | 828 |
| AD-1637800 | asusacu(Chd)uaCfAf AfaccaguugaaL96 | 513 | VPusdTscadAc(Tgn)gg uudTgUfadGaguauscsu | 671 | AAAUAGUCUACAAAC CAGUUGAC | 829 |
| AD-1637801 | asusugu(Chd)uaCfAf AfaccaguugaaL96 | 514 | VPusdTscadAc(Tgn)gg uudTgUfadGacaauscsu | 672 | AAAUAGUCUACAAAC CAGUUGAC | 830 |
| AD-1637802 | asusagu(Chd)uaCfAf AfaccaauugaaL96 | 515 | VPusdTscadAudTgguu dTgUfagacuauscsu | 673 | AAAUAGUCUACAAAC CAGUUGAC | 831 |
| AD-1637803 | asusagu(Chd)uaCfAf AfaccuguugaaL96 | 516 | VPusdTscadAcdAgguu dTgUfagacuauscsu | 674 | AAAUAGUCUACAAAC CAGUUGAC | 832 |
| AD-1637804 | asusagu(Chd)uaCfAf AfacccguugaaL96 | 517 | VPusdTscadAcdGgguu dTgUfagacuauscsu | 675 | AAAUAGUCUACAAAC CAGUUGAC | 833 |
| AD-1637805 | asusagu(Chd)uaCfAf AfaccgguugaaL96 | 518 | VPusdTscadAcdCgguu dTgUfagacuauscsu | 676 | AAAUAGUCUACAAAC CAGUUGAC | 834 |
| AD-1637806 | asasauag(Uhd)cUfAf CfaaaccaguuaL96 | 519 | VPusAfsacdTg(G2p)uu uguaGfaCfuauuusgsc | 677 | GCAAAUAGUCUACAA ACCAGUUG | 835 |
| AD-1637807 | asasauag(Uhd)cUfAf CfaaaccaguuaL96 | 520 | VPusAfsacdTg(G2p)uu ugdTaGfaCfuauuusgsc | 678 | GCAAAUAGUCUACAA ACCAGUUG | 836 |
| AD-1637808 | asasauag(Uhd)cUfAf CfaaaccaguuaL96 | 521 | VPusdAsacdTg(G2p)uu ugdTaGfacuauuusgsc | 679 | GCAAAUAGUCUACAA ACCAGUUG | 837 |
| AD-1637809 | asasauag(Uhd)cUfAf CfaaaccaguuaL96 | 522 | VPusdAsacdTg(G2p)uu ugdTadGadCuauuuscsu | 680 | GCAAAUAGUCUACAA ACCAGUUG | 838 |
| AD-1637810 | asasauug(Uhd)cUfAf CfaaaccaguuaL96 | 523 | VPusAfsacdTg(G2p)uu uguaGfaCfaauuusgsc | 681 | GCAAAUAGUCUACAA ACCAGUUG | 839 |
| AD-1637811 | asasaaag(Uhd)cUfAf CfaaaccaguuaL96 | 524 | VPusAfsacdTg(G2p)uu uguaGfaCfuuuuusgsc | 682 | GCAAAUAGUCUACAA ACCAGUUG | 840 |
| AD-1637812 | asasuuag(Uhd)cUfAf CfaaaccaguuaL96 | 525 | VPusAfsacdTg(G2p)uu uguaGfaCfuaauusgsc | 683 | GCAAAUAGUCUACAA ACCAGUUG | 841 |
| AD-1637813 | asasauag(Uhd)cUfAf CfaaaccaguuaL96 | 526 | VPusAfsacudGg(Tgn)u uguaGfaCfuauuusgsc | 684 | GCAAAUAGUCUACAA ACCAGUUG | 842 |
| AD-1637814 | asasauag(Uhd)cUfAf CfaaaccaguuaL96 | 527 | VPusAfsacudGg(Tgn)u ugdTaGfaCfuauuusgsc | 685 | GCAAAUAGUCUACAA ACCAGUUG | 843 |
| AD-1637815 | asasauag(Uhd)cUfAf CfaaacgaguuaL96 | 528 | VPusdAsacdTcdGuuug dTaGfacuauuusgsc | 686 | GCAAAUAGUCUACAA ACCAGUUG | 844 |
| AD-1637816 | gscsucg(Chd)auGfGf UfcaguaaaagaL96 | 529 | VPusCfsuudTu(Agn)cu gadCcAfuGfcgagcsusu | 687 | AAGCUCGCAUGGUCA GUAAAAGC | 845 |
| AD-1637817 | gscsucg(Chd)auGfGf UfcaguaaaagaL96 | 530 | VPusCfsuudTu(Agn)cu gaccAfuGfcgagcsusu | 688 | AAGCUCGCAUGGUCA GUAAAAGC | 846 |
| AD-1637818 | gscsucg(Chd)auGfGf UfcaguaaaagaL96 | 531 | VPusCfsuudTu(Agn)cu gadCcAfugcgagcsusu | 689 | AAGCUCGCAUGGUCA GUAAAAGC | 847 |
| AD-1637819 | gscsucc(Chd)auGfGf UfcaguaaaagaL96 | 532 | VPusCfsuudTu(Agn)cu gaccAfuGfggagcsusu | 690 | AAGCUCGCAUGGUCA GUAAAAGC | 848 |

TABLE 4-continued

Modified Sense and Antisense Strand Sequences of MAPT dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1637820 | gscsugg(Chd)auGfGf UfcaguaaaagaL96 | 533 | VPusCfsuudTu(Agn)cu gaccAfuGfccagcsusu | 691 | AAGCUCGCAUGGUCA GUAAAAGC | 849 |
| AD-1637821 | gscsacg(Chd)auGfGf UfcaguaaaagaL96 | 534 | VPusCfsuudTu(Agn)cu gaccAfuGfcgugcsusu | 692 | AAGCUCGCAUGGUCA GUAAAAGC | 850 |
| AD-1637822 | gscsucg(Chd)auGfGf UfcauuaaaagaL96 | 535 | VPusdCsuudTudAauga dCcAfugcgagcsusu | 693 | AAGCUCGCAUGGUCA GUAAAAGC | 851 |
| AD-1637823 | gscsucg(Chd)auGfGf UfcaguuaaagaL96 | 536 | VPusdCsuudTadAcuga dCcAfugcgagcsusu | 694 | AAGCUCGCAUGGUCA GUAAAAGC | 852 |
| AD-1637824 | gscsucc(Chd)auGfGf UfcacuaaaagaL96 | 537 | VPusdCsuudTudAauga dCcAfugggagcsusu | 695 | AAGCUCGCAUGGUCA GUAAAAGC | 853 |
| AD-1637825 | gscsucc(Chd)auGfGf UfcaguuaaagaL96 | 538 | VPusdCsuudTadAcuga dCcAfugggagcsusu | 696 | AAGCUCGCAUGGUCA GUAAAAGC | 854 |
| AD-1637826 | gscsugg(Chd)auGfGf UfcacuaaaagaL96 | 539 | VPusdCsuudTudAauga dCcAfugccagcsusu | 697 | AAGCUCGCAUGGUCA GUAAAAGC | 855 |
| AD-1637827 | gscsugg(Chd)auGfGf UfcaguuaaagaL96 | 540 | VPusdCsuudTadAcuga dCcAfugccagcsusu | 698 | AAGCUCGCAUGGUCA GUAAAAGC | 856 |
| AD-1637828 | gscsacg(Chd)auGfGf UfcacuaaaagaL96 | 541 | VPusdCsuudTudAauga dCcAfugcgugcsusu | 699 | AAGCUCGCAUGGUCA GUAAAAGC | 857 |
| AD-1637829 | gscsacg(Chd)auGfGf UfcaguuaaagaL96 | 542 | VPusdCsuudTadAcuga dCcAfugcgugcsusu | 700 | AAGCUCGCAUGGUCA GUAAAAGC | 858 |
| AD-1637830 | asuscug(Ahd)gaAfGf CfuugacuucaaL96 | 543 | VPusUfsgaadGu(Cgn)a agcuUfcUfcagaususu | 701 | AAAUCUGAGAAGCUU GACUUCAA | 859 |
| AD-1637831 | asuscug(Ahd)gaAfGf CfuugacuucaaL96 | 544 | VPusUfsgadAg(Tgn)ca agdCuUfcUfcagaususu | 702 | AAAUCUGAGAAGCUU GACUUCAA | 860 |
| AD-1637832 | asuscug(Ahd)gaAfGf CfuugacuucaaL96 | 545 | VPusUfsgadAg(Tgn)ca agdCuUfcdTcagaususu | 703 | AAAUCUGAGAAGCUU GACUUCAA | 861 |
| AD-1637833 | asuscug(Ahd)gaAfGf CfuugacuucaaL96 | 546 | VPusdTsgadAg(Tgn)ca agdCuUfcdTcagaususu | 704 | AAAUCUGAGAAGCUU GACUUCAA | 862 |
| AD-1637834 | asuscug(Ahd)gaAfGf CfuugacuucaaL96 | 547 | VPusdTsgadAg(Tgn)ca agdCudTcdTcagaususu | 705 | AAAUCUGAGAAGCUU GACUUCAA | 863 |
| AD-1637835 | asuscuc(Ahd)gaAfGf CfuugacuucaaL96 | 548 | VPusUfsgadAg(Tgn)ca agdCuUfcUfgagaususu | 706 | AAAUCUGAGAAGCUU GACUUCAA | 864 |
| AD-1637836 | asuscuu(Ahd)gaAfGf CfuugacuucaaL96 | 549 | VPusUfsgadAg(Tgn)ca agdCuUfcUfaagaususu | 707 | AAAUCUGAGAAGCUU GACUUCAA | 865 |
| AD-1637837 | asuscag(Ahd)gaAfGf CfuugacuucaaL96 | 550 | VPusUfsgadAg(Tgn)ca agdCuUfcUfcugaususu | 708 | AAAUCUGAGAAGCUU GACUUCAA | 866 |
| AD-1637838 | asusgug(Ahd)gaAfGf CfuugacuucaaL96 | 551 | VPusUfsgadAg(Tgn)ca agdCuUfcUfcacaususu | 709 | AAAUCUGAGAAGCUU GACUUCAA | 867 |
| AD-1637839 | asusaug(Ahd)gaAfGf CfuugacuucaaL96 | 552 | VPusUfsgadAg(Tgn)ca agdCuUfcUfcauaususu | 710 | AAAUCUGAGAAGCUU GACUUCAA | 868 |
| AD-1637840 | asuscug(Ahd)gaAfGf CfuugauuucaaL96 | 553 | VPusUfsgadAadTcaagc uUfcUfcagaususu | 711 | AAAUCUGAGAAGCUU GACUUCAA | 869 |
| AD-1637841 | cscsg(Ahd)gaAfGfCf uugacuucaaL96 | 554 | VPusUfsgadAg(Tgn)ca agcuUfcUfcagsgsu | 712 | AUCUGAGAAGCUUGA CUUCAA | 870 |
| AD-1637842 | cscsg(Ahd)gaAfGfCf uugacuucaaL96 | 555 | VPusdTsgadAg(Tgn)ca agdCuUfcdTcagsgsu | 713 | AUCUGAGAAGCUUGA CUUCAA | 871 |
| AD-1637843 | asusggu(Chd)agUfAf AfaagcaaagaaL96 | 556 | VPusUfscudTu(G2p)cu uudTaCfugaccausgsc | 714 | GCAUGGUCAGUAAAA GCAAAGAC | 872 |

TABLE 4-continued

Modified Sense and Antisense Strand Sequences of MAPT dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1637844 | asusggu(Chd)agUfAf AfaagcaaagaaL96 | 557 | VPusUfscudTu(G2p)cu uudTaCfudGaccausgsc | 715 | GCAUGGUCAGUAAAA GCAAAGAC | 873 |
| AD-1637845 | asusggu(Chd)agUfAf AfaagcaaagaaL96 | 558 | VPusdTscudTu(G2p)cu uudTaCfudGaccausgsc | 716 | GCAUGGUCAGUAAAA GCAAAGAC | 874 |
| AD-1637846 | asusggu(Chd)agdTa AfdAagcaaagaaL96 | 559 | VPusdTscudTu(G2p)cu uudTaCfudGaccausgsc | 717 | GCAUGGUCAGUAAAA GCAAAGAC | 875 |
| AD-1637847 | asusggu(Chd)agdTa AfAfagcaaagaaL96 | 560 | VPusdTscudTu(G2p)cu uudTaCfudGaccausgsc | 718 | GCAUGGUCAGUAAAA GCAAAGAC | 876 |
| AD-1637848 | asusgga(Chd)agUfAf AfaagcaaagaaL96 | 561 | VPusdTscudTu(G2p)cu uudTaCfudGuccausgsc | 719 | GCAUGGUCAGUAAAA GCAAAGAC | 877 |
| AD-1637849 | asusgcu(Chd)agUfAf AfaagcaaagaaL96 | 562 | VPusdTscudTu(G2p)cu uudTaCfudGagcausgsc | 720 | GCAUGGUCAGUAAAA GCAAAGAC | 878 |
| AD-1637850 | asuscgu(Chd)agUfAf AfaagcaaagaaL96 | 563 | VPusdTscudTu(G2p)cu uudTaCfudGacgausgsc | 721 | GCAUGGUCAGUAAAA GCAAAGAC | 879 |
| AD-1637851 | asusggu(Chd)agUfAf AfaagcaaagaaL96 | 1092 | VPusUfscdTu(Tgn)gcu uuuaCfuGfaccausgsc | 722 | GCAUGGUCAGUAAAA GCAAAGAC | 880 |
| AD-1637852 | asusggu(Chd)agUfAf AfaagcaaagaaL96 | 1093 | VPusUfscdTu(Tgn)gcu uudTaCfuGfaccausgsc | 723 | GCAUGGUCAGUAAAA GCAAAGAC | 881 |
| AD-1637853 | asusggu(Chd)agUfAf AfaagcaaagaaL96 | 1094 | VPusdTscdTu(Tgn)gcu uudTaCfugaccausgsc | 724 | GCAUGGUCAGUAAAA GCAAAGAC | 882 |
| AD-1637854 | asusggu(Chd)agUfAf AfaagcgaagaaL96 | 1095 | VPusdTscudTcdGcuuu dTaCfugaccausgsc | 725 | GCAUGGUCAGUAAAA GCAAAGAC | 883 |
| AD-1637855 | asusggu(Chd)agUfAf AfaaguaaagaaL96 | 1096 | VPusdTscudTudAcuuu dTaCfugaccausgsc | 726 | GCAUGGUCAGUAAAA GCAAAGAC | 884 |
| AD-1637856 | asusggu(Chd)agUfAf AfaagaaaagaaL96 | 1097 | VPusdTscudTudTcuuud TaCfugaccausgsc | 727 | GCAUGGUCAGUAAAA GCAAAGAC | 885 |
| AD-1637857 | gscsaaa(Chd)caGfUf UfgaccugagcaL96 | 1098 | VPusGfscdTc(Agn)ggu caacUfgGfuuugusasg | 728 | CUACAAACCAGUUGA CCUGAGCA | 886 |
| AD-1637858 | gscsaau(Chd)caGfUf UfgaccugagcaL96 | 1099 | VPusGfscdTc(Agn)ggu caacUfgGfauugusasg | 729 | CUACAAACCAGUUGA CCUGAGCA | 887 |
| AD-1637859 | gscsaua(Chd)caGfUf UfgaccugagcaL96 | 1100 | VPusGfscdTc(Agn)ggu caacUfgGfuaugusasg | 730 | CUACAAACCAGUUGA CCUGAGCA | 888 |
| AD-1637860 | gscsuaa(Chd)caGfUf UfgaccugagcaL96 | 1101 | VPusGfscdTc(Agn)ggu caacUfgGfuuagusasg | 731 | CUACAAACCAGUUGA CCUGAGCA | 889 |
| AD-1637861 | gscsaaa(Chd)caGfUf UfgacuugagcaL96 | 1102 | VPusGfscudCadAgucaa cUfgGfuuugusasg | 732 | CUACAAACCAGUUGA CCUGAGCA | 890 |
| AD-1637862 | gscsaau(Chd)caGfUf UfgacuugagcaL96 | 1103 | VPusGfscudCadAgucaa cUfgGfauugusasg | 733 | CUACAAACCAGUUGA CCUGAGCA | 891 |
| AD-1637863 | gscsaua(Chd)caGfUf UfgacuugagcaL96 | 1104 | VPusGfscudCadAgucaa cUfgGfuaugusasg | 734 | CUACAAACCAGUUGA CCUGAGCA | 892 |
| AD-1637864 | gscsuaa(Chd)caGfUf UfgacuugagcaL96 | 1105 | VPusGfscudCadAgucaa cUfgGfuuagusasg | 735 | CUACAAACCAGUUGA CCUGAGCA | 893 |
| AD-1637865 | gscsaaa(Chd)caGfUf UfgaccugagcaL96 | 1106 | VPusGfscudCudGgucaa cUfgGfuuugusasg | 736 | CUACAAACCAGUUGA CCUGAGCA | 894 |
| AD-1637866 | gscsaau(Chd)caGfUf UfgaccagagcaL96 | 1107 | VPusGfscudCudGgucaa cUfgGfauugusasg | 737 | CUACAAACCAGUUGA CCUGAGCA | 895 |
| AD-1637867 | gscsaua(Chd)caGfUf UfgaccagagcaL96 | 1108 | VPusGfscudCudGgucaa cUfgGfuaugusasg | 738 | CUACAAACCAGUUGA CCUGAGCA | 896 |

TABLE 4-continued

Modified Sense and Antisense Strand Sequences of MAPT dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1637868 | gscsuaa(Chd)caGfUf UfgaccagagcaL96 | 1109 | VPusGfscudCudGgucaa cUfgGfuuagusasg | 739 | CUACAAACCAGUUGA CCUGAGCA | 897 |
| AD-1637869 | usgsgaa(Ahd)uaAfAf GfuuauuacucaL96 | 1110 | VPusGfsaguAfaUfAfac uuUfaUfuuccasasa | 1180 | UUUGGAAAUAAAGUU AUUACUCU | 898 |
| AD-1637870 | usgsgaa(Ahd)uaAfAf GfuuauuacucaL96 | 1111 | VPusGfsagdTa(Agn)ua lacuuUfaUfuuccasasa | 1181 | UUUGGAAAUAAAGUU AUUACUCU | 899 |
| AD-1637871 | usgsgaa(Ahd)uaAfAf GfuuauuacucaL96 | 1112 | VPusGfsagdTa(Agn)ua acuuUfaUfuuccasgsg | 1182 | UUUGGAAAUAAAGUU AUUACUCU | 900 |
| AD-1637872 | usgsgaa(Ahd)uaAfAf GfuuauuacucaL96 | 1113 | VPusGfsagdTa(Agn)ua acdTuUfaUfuuccasgsg | 1183 | UUUGGAAAUAAAGUU AUUACUCU | 901 |
| AD-1637873 | usgsgaa(Ahd)uaAfAf GfuuauuacucaL96 | 1114 | VPusGfsagdTa(Agn)ua acdTuUfadTuuccasgsg | 1184 | UUUGGAAAUAAAGUU AUUACUCU | 902 |
| AD-1637874 | usgsgaa(Ahd)uaAfAf GfuuauuacucaL96 | 1115 | VPusdGsagdTa(Agn)ua acdTuUfaUfuuccasgsg | 1185 | UUUGGAAAUAAAGUU AUUACUCU | 903 |
| AD-1637875 | usgsgau(Ahd)uaAfAf GfuuauuacucaL96 | 1116 | VPusGfsagdTa(Agn)ua acdTuUfaUfauccasgsg | 1186 | UUUGGAAAUAAAGUU AUUACUCU | 904 |
| AD-1637876 | usgsgua(Ahd)uaAfAf GfuuauuacucaL96 | 1117 | VPusGfsagdTa(Agn)ua acdTuUfaUfuaccasgsg | 1187 | UUUGGAAAUAAAGUU AUUACUCU | 905 |
| AD-1637877 | usgscaa(Ahd)uaAfAf GfuuauuacucaL96 | 1118 | VPusGfsagdTa(Agn)ua acdTuUfaUfuugcasgsg | 1188 | UUUGGAAAUAAAGUU AUUACUCU | 906 |
| AD-1637878 | csgscaugGfuCfAfGf luaaa(Ahd)gcaaaL96 | 1119 | VPusUfsugcUfuUfUfac ugAfcCfaugcgsasg | 1189 | CUCGCAUGGUCAGUA AAAGCAAA | 907 |
| AD-1637879 | csgscaugGfuCfAfGf uaaa(Ahd)gcaaaL96 | 1120 | VPusUfsugdCu(Tgn)uu acugAfcCfaugcgsasg | 1190 | CUCGCAUGGUCAGUA AAAGCAAA | 908 |
| AD-1637880 | csgscaugGfuCfAfGf uaaa(Ahd)gcaaaL96 | 1121 | VPusUfsugdCu(Tgn)uu acugAfcCfaugcgsgsg | 1191 | CUCGCAUGGUCAGUA AAAGCAAA | 909 |
| AD-1637881 | csgscaugGfuCfAfGf uaaa(Ahd)gcaaaL96 | 1122 | VPusUfsugdCu(Tgn)uu acdTgAfcCfaugcgsgsg | 1192 | CUCGCAUGGUCAGUA AAAGCAAA | 910 |
| AD-1637882 | csgscaugGfuCfAfGf uaaa(Ahd)gcaaaL96 | 1123 | VPusUfsugdCu(Tgn)uu acdTgAfcdCaugcgsgsg | 1193 | CUCGCAUGGUCAGUA AAAGCAAA | 911 |
| AD-1637883 | csgscaugGfuCfAfGf uaaa(Ahd)gcaaaL96 | 1124 | VPusdTsugdCu(Tgn)uu acdTgAfcdCaugcgsgsg | 1194 | CUCGCAUGGUCAGUA AAAGCAAA | 912 |
| AD-1637884 | csgscaugGfuCfAfGf uaaa(Ahd)gcaaaL96 | 1125 | VPusdTsugdCu(Tgn)uu acdTgdAcdCaugcgsgsg | 1195 | CUCGCAUGGUCAGUA AAAGCAAA | 913 |
| AD-1637885 | csasugGfuCfAfGfua aa(Ahd)gcaaaL96 | 1126 | VPusUfsugdCu(Tgn)uu acugAfcCfaugscsg | 1196 | CGCAUGGUCAGUAAA AGCAAA | 914 |
| AD-1637886 | csasugGfuCfAfGfua aa(Ahd)gcaaaL96 | 1127 | VPusdTsugdCu(Tgn)uu acdTgAfcCfaugscsg | 1197 | CGCAUGGUCAGUAAA AGCAAA | 915 |
| AD-1637887 | csasugGfuCfAfGfua aa(Ahd)gcaaaL96 | 1128 | VPusdTsugdCu(Tgn)uu acdTgAfcdCaugscsg | 1198 | CGCAUGGUCAGUAAA AGCAAA | 916 |
| AD-1637888 | csgscaugguCfAfGfua aa(Ahd)gcaaaL96 | 1129 | VPusUfsugdCu(Tgn)uu acugAfcCfaugcgsasg | 1199 | CUCGCAUGGUCAGUA AAAGCAAA | 917 |
| AD-1637889 | csgscaagguCfAfGfua aa(Ahd)gcaaaL96 | 1130 | VPusUfsugdCu(Tgn)uu acugAfcCfuugcgsasg | 1200 | CUCGCAUGGUCAGUA AAAGCAAA | 918 |
| AD-1637890 | csgscuugguCfAfGfu aaa(Ahd)gcaaaL96 | 1131 | VPusUfsugdCu(Tgn)uu acugAfcCfaagcgsasg | 1201 | CUCGCAUGGUCAGUA AAAGCAAA | 919 |
| AD-1637891 | csgsgaugguCfAfGfu aaa(Ahd)gcaaaL96 | 1132 | VPusUfsugdCu(Tgn)uu acugAfcCfauccgsasg | 1202 | CUCGCAUGGUCAGUA AAAGCAAA | 920 |

TABLE 4-continued

Modified Sense and Antisense Strand Sequences of MAPT dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1637892 | gsgsuca(Chd)GfuGf AfCfccaagcucgaL96 | 1133 | VPusCfsgadGc(Tgn)ug gucAfcGfugaccsasg | 1203 | CUGGUCACGUGACCC AAGCUCGC | 921 |
| AD-1637893 | gsuscacg(Uhd)gAfCf CfcaagcucgcaL96 | 1134 | VPusGfscgdAg(C2p)uu ggguCfaCfgugacscsa | 1204 | UGGUCACGUGACCCA AGCUCGCA | 922 |
| AD-1637894 | uscsacg(Uhd)GfaCfC fCfaagcucgcaaL96 | 1135 | VPusUfsgcdGa(G2p)cu ugggUfcAfcgugascsc | 1205 | GGUCACGUGACCCAA GCUCGCAU | 923 |
| AD-1637895 | csascg(Uhd)gacCfCf AfagcucgcauaL96 | 1136 | VPusdAsugdCgdAgcuu dGgGfucacgugsasc | 1206 | GUCACGUGACCCAAG CUCGCAUG | 924 |
| AD-1637896 | csascg(Uhd)gAfcCfC fAfagcucgcauaL96 | 1137 | VPusAfsugdCg(Agn)gc uuggGfuCfacgugsasc | 1207 | GUCACGUGACCCAAG CUCGCAUG | 925 |
| AD-1637897 | ascsgug(Ahd)CfcCf AfAfgcucgcaugaL96 | 1138 | VPusCfsaudGc(G2p)ag cuugGfgUfcacgusgsa | 1208 | UCACGUGACCCAAGC UCGCAUGG | 926 |
| AD-1637898 | AfGfcucgcauggaL96 csgsuga(Chd)CfcAf | 1139 | VPusCfscadTg(C2p)ga gcuuGfgGfucacgsusg | 1209 | CACGUGACCCAAGCU CGCAUGGU | 927 |
| AD-1637899 | gsusgac(Chd)CfaAf GfCfucgcaugguaL96 | 1140 | VPusAfsccdAu(G2p)cg agcuUfgGfgucacsgsu | 1210 | ACGUGACCCAAGCUC GCAUGGUC | 928 |
| AD-1637900 | usgsacc(Chd)AfaGfC fUfcgcauggucaL96 | 1141 | VPusGfsacdCa(Tgn)gc gagcUfuGfggucascsg | 1211 | CGUGACCCAAGCUCG CAUGGUCA | 929 |
| AD-1637901 | UfCfgcauggucaaL96 gsasccc(Ahd)AfgCf | 1142 | VPusUfsgadCc(Agn)ug cgagCfuUfgggucsasc | 1212 | GUGACCCAAGCUCGC AUGGUCAG | 930 |
| AD-1637902 | ascscca(Ahd)GfcUfC fGfcauggucagaL96 | 1143 | VPusCfsugdAc(C2p)au gcgaGfcUfuggguscsa | 1213 | UGACCCAAGCUCGCA UGGUCAGU | 931 |
| AD-1637903 | cscscaag(Chd)uCfGf CfauggucaguaL96 | 1144 | VPusAfscudGa(C2p)ca ugcgAfgCfuugggsusc | 1214 | GACCCAAGCUCGCAU GGUCAGUA | 932 |
| AD-1637904 | cscsaag(Chd)UfcGfC fAfuggucaguaaL96 | 1145 | VPusUfsacdTg(Agn)cc augcGfaGfcuuggsgsu | 1215 | ACCCAAGCUCGCAUG GUCAGUAA | 933 |
| AD-1637905 | csasagc(Uhd)CfgCfA fUfggucaguaaaL96 | 1146 | VPusUfsuadCu(G2p)ac caugCfgAfgcuugsgsg | 1216 | CCCAAGCUCGCAUGG UCAGUAAA | 934 |
| AD-1637906 | asasgcu(Chd)GfcAf UfGfgucaguaaaaL96 | 1147 | VPusUfsuudAc(Tgn)ga ccauGfcGfagcuusgsg | 1217 | CCAAGCUCGCAUGGU CAGUAAAA | 935 |
| AD-1637907 | asgscucg(Chd)aUfGf \|GfucaguaaaaaL96 | 1148 | VPusUfsuudTa(C2p)ug accaUfgCfgagcusus g | 1218 | CAAGCUCGCAUGGUC AGUAAAAG | 936 |
| AD-1637908 | csuscgc(Ahd)UfgGf UfCfaguaaaagcaL96 | 1149 | VPusGfscudTu(Tgn)ac ugacCfaUfgcgagscsu | 1219 | AGCUCGCAUGGUCAG UAAAAGCA | 937 |
| AD-1637909 | uscsgca(Uhd)GfgUf CfAfguaaaagcaaL96 | 1150 | VPusUfsgcdTu(Tgn)ua cugaCfcAfugcgasgsc | 1220 | GCUCGCAUGGUCAGU AAAAGCAA | 938 |
| AD-1637910 | csgsca(Uhd)gGfuCf AfGfuaaaagcaaaL96 | 1151 | VPusUfsugdCu(Tgn)uu acugAfcCfaugcgsasg | 1221 | CUCGCAUGGUCAGUA AAAGCAAA | 939 |
| AD-1637911 | gscsaugg(Uhd)cAfGf UfaaaagcaaaaL96 | 1152 | VPusUfsuudGc(Tgn)uu uacuGfaCfcaugcsgsa | 1222 | UCGCAUGGUCAGUAA AAGCAAAG | 940 |
| AD-1637912 | csasugg(Uhd)CfaGf UfAfaaagcaaagaL96 | 1153 | VPusCfsuudTg(C2p)uu uuacUfgAfccaugscsg | 1223 | CGCAUGGUCAGUAAA AGCAAAGA | 941 |
| AD-1637913 | asusggu(Chd)AfgUf AfAfaagcaaagaaL96 | 1154 | VPusUfscudTu(G2p)cu uuuaCfuGfaccausgsc | 1224 | GCAUGGUCAGUAAAA\| GCAAAGAC | 942 |
| AD-1637914 | usgsguc(Ahd)GfuAf AfAfagcaaagacaL96 | 1155 | VPusGfsucdTu(Tgn)gc uuuuAfcUfgaccasusg | 1225 | CAUGGUCAGUAAAAG CAAAGACG | 943 |
| AD-1637915 | gsgsucag(Uhd)aAfAf AfgcaaagacgaL96 | 1156 | VPusCfsgudCu(Tgn)ug cuuuUfaCfugaccsasu | 1226 | AUGGUCAGUAAAAGC AAAGACGG | 944 |

TABLE 4-continued

Modified Sense and Antisense Strand Sequences of MAPT dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1637916 | gsuscag(Uhd)AfaAf AfGfcaaagacggaL96 | 1157 | VPusCfscgdTc(Tgn)uu gcuuUfuAfcugacscsa | 1227 | UGGUCAGUAAAAGCA AAGACGGG | 945 |
| AD-1637917 | asgsuaa(Ahd)agCfAf AfagacgggacaL96 | 1158 | VPusdGsucdCcdGucuu dTgCfuuuuacusgsa | 1228 | UCAGUAAAAGCAAAG ACGGGACU | 946 |
| AD-1637918 | asgsuaa(Ahd)AfgCf AfAfagacgggacaL96 | 1159 | VPusGfsucdCc(G2p)uc uuugCfuUfuuacusgsa | 1229 | UCAGUAAAAGCAAAG ACGGGACU | 947 |
| AD-1637919 | gsusgug(Chd)AfaAf UfAfgucuacaaaaL96 | 1160 | VPusUfsuudGu(Agn)ga cuauUfuGfcacacsusg | 1230 | GAAGGUGCAAAUAGU CUACAAAC | 948 |
| AD-1637920 | usgsugc(Ahd)AfaUf AfGfucuacaaacaL96 | 1161 | VPusGfsuudTg(Tgn)ag acuaUfuUfgcacascsu | 1231 | AAGGUGCAAAUAGUC UACAAACC | 949 |
| AD-1637921 | gsusgca(Ahd)AfuAf GfUfcuacaaaccaL96 | 1162 | VPusGfsgudTu(G2p)ua gacuAfuUfugcacsasc | 1232 | AGGUGCAAAUAGUCU ACAAACCA | 950 |
| AD-1637922 | usgscaa(Ahd) UfaGf UfCfuacaaaccaaL96 | 1163 | VPusUfsggdTu(Tgn)gu agacUfaUfuugcascsa | 1233 | GGUGCAAAUAGUCUA CAAACCAG | 951 |
| AD-1637923 | gscsaaa(Uhd)AfgUf CfUfacaaaccagaL96 | 1164 | VPusCfsugdGu(Tgn)ug agaCfuAfuuugcsasc | 1234 | GUGCAAAUAGUCUAC AAACCAGU | 952 |
| AD-1637924 | csasaau(Ahd)GfuCf UfAfcaaaccaguaL96 | 1165 | VPusAfscudGg(Tgn)uu guagAfcUfauuugcsca | 1235 | UGCAAAUAGUCUACA AACCAGUU | 953 |
| AD-1637925 | asasuag(Uhd)CfuAf CfAfaaccaguugaL96 | 1166 | VPusCfsaadCu(G2p)gu uuguAfgAfcuauususg | 1236 | CAAAUAGUCUACAAA CCAGUUGA | 954 |
| AD-1637926 | asusagu(Chd)UfaCf AfAfaccaguugaaL96 | 1167 | VPusUfscadAc(Tgn)gg uuugUfaGfacuausus u | 1237 | AAAUAGUCUACAAAC CAGUUGAC | 955 |
| AD-1637927 | usasguc(Uhd) AfcAf AfAfccaguugacaL96 | 1168 | VPusGfsucdAa(C2p)ug guuuGfuAfgacuasusu | 1238 | AAUAGUCUACAAACC AGUUGACC | 956 |
| AD-1637928 | asgsucu(Ahd)CfaAf AfCfcaguugaccaL96 | 1169 | VPusGfsgudCa(Agn)cu gguuUfgUfagacusasu | 1239 | AUAGUCUACAAACCA GUUGACCU | 957 |
| AD-1637929 | gsuscua(Chd)AfaAf CfCfaguugaccuaL96 | 1170 | VPusAfsggdTc(Agn)ac ugguUfuGfuagacsusa | 1240 | UAGUCUACAAACCAG UUGACCUG | 958 |
| AD-1637930 | uscsuac(Ahd)AfaCfC fAfguugaccugaL96 | 1171 | VPusCfsagdGu(C2p)aa cuggUfuUfguagascsu | 1241 | AGUCUACAAACCAGU UGACCUGA | 959 |
| AD-1637931 | csusaca(Ahd)AfcCfA fGfuugaccugaaL96 | 1172 | VPusUfscadGg(Tgn)ca acugGfuUfuguagsasc | 1242 | GUCUACAAACCAGUU GACCUGAG | 960 |
| AD-1637932 | usascaa(Ahd)CfcAfG fUfugaccugagaL96 | 1173 | VPusCfsucdAg(G2p)uc aacuGfgUfuuguasgsa | 1243 | UCUACAAACCAGUUG ACCUGAGC | 961 |
| AD-1637933 | ascsaaa(Chd)CfaGfU fUfgaccugagcaL96 | 1174 | VPusGfscudCa(G2p)gu caacUfgGfuuugusasg | 1244 | CUACAAACCAGUUGA CCUGAGCA | 962 |
| AD-1637934 | csasaac(Chd)AfgUfU fGfaccugagcaaL96 | 1175 | VPusUfsgcdTc(Agn)gg ucaaCfuGfguuugsusa | 1245 | UACAAACCAGUUGAC CUGAGCAA | 963 |
| AD-1637935 | asasacc(Ahd)GfuUf GfAfccugagcaaaL96 | 1176 | VPusUfsugdCu(C2p)ag gucaAfcUfgguuugsgu | 1246 | ACAAACCAGUUGACC UGAGCAAG | 964 |
| AD-1637936 | asasccag(Uhd)uGfAf CfcugagcaagaL96 | 1177 | VPusCfsuudGc(Tgn)ca ggucAfaCfugguusu sg | 1247 | CAAACCAGUUGACCU GAGCAAGG | 965 |
| AD-1637937 | ascscag(Uhd)UfgAf CfCfugagcaaggaL96 | 1178 | VPusCfscudTg(C2p)uc agguCfaAfcuggususu | 1248 | AAACCAGUUGACCUG AGCAAGGU | 966 |
| AD-1637938 | cscsagu(Uhd)GfaCfC fUfgagcaagguaL96 | 1179 | VPusAfsccdTu(G2p)cu caggUfcAfacuggsusu | 1249 | AACCAGUUGACCUGA GCAAGGUG | 967 |
| AD-1637939 | csasgu(Uhd)gacCfUf GfagcaaggugaL96 | 564 | VPusdCsacdCudTgcucd AgGfucaacugsgsu | 1250 | ACCAGUUGACCUGAG CAAGGUGA | 968 |

TABLE 4-continued

Modified Sense and Antisense Strand Sequences of MAPT dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1637940 | asgsuaa(Ahd)AfuCf UfGfagaagcuugaL96 | 565 | VPusCfsaadGc(Tgn)uc ucagAfuUfuuacususc | 1251 | GAAGUAAAAUCUGAG AAGCUUGA | 969 |
| AD-1637941 | gsusaaa(Ahd)UfcUf GfAfgaagcuugaaL96 | 566 | VPusUfscadAg(C2p)uu cucaGfaUfuuuacsusu | 1252 | AAGUAAAAUCUGAGA AGCUUGAC | 970 |
| AD-1637942 | usasaaa(Uhd)CfuGf AfGfaagcuugacaL96 | 567 | VPusGfsucdAa(G2p)cu ucucAfgAfuuuuascsu | 1253 | AGUAAAAUCUGAGAA GCUUGACU | 971 |
| AD-1637943 | asasaau(Chd)UfgAf GfAfagcuugacuaL96 | 568 | VPusAfsgudCa(Agn)gc uucuCfaGfauuuusasc | 1254 | GUAAAAUCUGAGAAG CUUGACUU | 972 |
| AD-1637944 | asasauc(Uhd)GfaGf AfAfgcuugacuuaL96 | 569 | VPusAfsagdTc(Agn)ag cuucUfcAfgauuusua | 1255 | UAAAAUCUGAGAAGC UUGACUUC | 973 |
| AD-1637945 | asasuc(Uhd)gAfgAf AfGfcuugacuucaL96 | 570 | VPusGfsaadGu(C2p)aa gcuuCfuCfagauusuu | 1256 | AAAAUCUGAGAAGCU UGACUUCA | 974 |
| AD-1637946 | asuscug(Ahd)GfaAf GfCfuugacuucaaL96 | 571 | VPusUfsgadAg(Tgn)ca agcuUfcUfcagausuu | 1257 | AAAUCUGAGAAGCUU GACUUCAA | 975 |
| AD-1637947 | uscsugag(Ahd)aGfCf UfugacuucaaaL96 | 572 | VPusUfsugdAa(G2p)uc aagcUfuCfucagasuu | 1258 | AAUCUGAGAAGCUUG ACUUCAAG | 976 |
| AD-1637948 | csusgag(Ahd)AfgCf UfUfgacuucaagaL96 | 573 | VPusCfsuudGa(Agn)gu caagCfuUfcucagsasu | 1259 | AUCUGAGAAGCUUGA CUUCAAGG | 977 |
| AD-1637949 | usgsaga(Ahd)gcUfUf GfacuucaaggaL96 | 574 | VPusdCscudTgdAaguc dAaGfcuucucasgsa | 1260 | UCUGAGAAGCUUGAC UUCAAGGA | 978 |
| AD-1637950 | gsasgaag(Chd)uUfGf AfcuucaaggaaL96 | 575 | VPusUfsccdTu(G2p)aa gucaAfgCfuucucsasg | 1261 | CUGAGAAGCUUGACU UCAAGGAC | 979 |
| AD-1637951 | asgsaag(Chd)UfuGf AfCfuucaaggacaL96 | 576 | VPusGfsucdCu(Tgn)ga agucAfaGfcuucuscsa | 1262 | UGAGAAGCUUGACUU CAAGGACA | 980 |
| AD-1637952 | gsasagc(Uhd)UfgAf CfUfucaaggacaaL96 | 577 | VPusUfsgudCc(Tgn)ug aaguCfaAfgcuucsusc | 1263 | GAGAAGCUUGACUUC AAGGACAG | 981 |
| AD-1637953 | ususugg(Ahd)aaUfAf AfaguuauuacaL96 | 578 | VPusdGsuadAudAacuu dTaUfuuccaaasusu | 1264 | AAUUUGGAAAUAAAG UUAUUACU | 982 |
| AD-1637954 | ususgga(Ahd)auAfAf AfguuauuacuaL96 | 579 | VPusdAsgudAadTaacu dTuAfuuuccaasasu | 1265 | AUUUGGAAAUAAAGU UAUUACUC | 983 |
| AD-1637955 | ususgga(Ahd)AfuAf AfAfguuauuacuaL96 | 580 | VPusAfsgudAa(Tgn)aa cuuuAfuUfuccaasasu | 1266 | AUUUGGAAAUAAAGU UAUUACUC | 984 |
| AD-1637956 | usgsgaa(Ahd)uaAfAf GfuuauuacucaL96 | 581 | VPusdGsagdTadAuaac dTuUfauuuccasasa | 1267 | UUUGGAAAUAAAGUU AUUACUCU | 985 |
| AD-1637957 | gsasaau(Ahd)AfaGf UfUfauuacucugaL96 | 582 | VPusCfsagdAg(Tgn)aa uaacUfuUfauuucscsa | 740 | UGGAAAUAAAGUUAU UACUCUGA | 986 |
| AD-1637958 | asasaua(Ahd)AfgUf UfAfuuacucugaaL96 | 583 | VPusUfscadGa(G2p)ua auaaCfuUfuauuucscsc | 741 | GGAAAUAAAGUUAUU ACUCUGAU | 987 |
| AD-1637959 | asasuaa(Ahd)GfuUf AfUfuacucugauaL96 | 584 | VPusAfsucdAg(Agn)gul aauaAfcUfuuauuusc | 742 | GAAAUAAAGUUAUUA CUCUGAUU | 988 |
| AD-1637960 | asusaaag(Uhd)uAfUf UfacucugauuaL96 | 585 | VPusAfsaudCa(G2p)ag uaauAfaCfuuuausuu | 743 | AAAUAAAGUUAUUAC UCUGAUUA | 989 |
| AD-397167 | usgsgaaaUfaAfAfGf uuauuacucaL96 | 586 | VPusGfsaguAfaUfAfac uuUfaUfuuccasasa | 744 | UUUGGAAAUAAAGUU AUUACUCU | 990 |
| AD-523565 | csgscaugGfuCfAfGf uaaaagcaaaL96 | 587 | VPusUfsugcUfuUfUfac ugAfcCfaugcgsasg | 745 | CUCGCAUGGUCAGUA AAAGCAAA | 991 |

TABLE 5

Additional Unmodified Sense and Antisense Strand Sequences of MAPT dsRNA Agents

| Duplex Name | Sense Sequence 5' to 3' | SEQ ID NO: | Range in NM_005910.6 | Antisense Sequence 5' to 3' | SEQ ID NO: | Range in NM_005910.6 |
|---|---|---|---|---|---|---|
| AD-1623140 | AUAGUCUACAAACCAGUUGAA | 997 | 1072-1092 | UUCAACTGGUUUGUAGACUAUUU | 1001 | 1070-1092 |
| AD-1637701 | UGCAAAUAGUCUACAAACCAA | 998 | 1067-1087 | UUGGTUTGUAGACUAUUUGCACA | 1002 | 1065-1087 |
| AD-1786708 | GUGACCCAAGCUCGUAUGGUA | 999 | 514-534 | UACCAUACGAGCUUGGGUCACGU | 1003 | 512-534 |
| AD-1786708v2 | GUGACCCAAGCUCGCAUGGUA | 1000 | 514-534 | UACCAUGCGAGCUUGGGUCACGU | 1004 | 512-534 |

TABLE 6

Additional Modified Sense and Antisense Strand Sequences of MAPT dsRNA Agents

| Duplex ID | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1623140 | asusagu(Chd)uaCfAfAfaccaguugsasa | 1005 | VPusUfscadAc(Tgn)gguuugUfaGfacuaususu | 1009 | AAAUAGUCUACAAACCAGUUGAC | 1013 |
| AD-1637701 | usgscaa(Ahd)UfaGfUfCfuacaaaccsasa | 1006 | VPusUfsggdTu(Tgn)guagacUfaUfuugcascsa | 1010 | UGUGCAAAUAGUCUACAAACCAG | 1014 |
| AD-1786708 | gsusgac(Chd)caAfGfCfucguauggsusa | 1007 | VPusAfsccdAudAcgagcuUfgGfgucacsgsu | 1011 | ACGUGACCCAAGCUCGCAUGGUC | 1015 |
| AD-1786708v2 | gsusgac(Chd)caAfGfCfucgcauggsusa | 1008 | VPusAfsccdAudGcgagcuUfgGfgucacsgsu | 1012 | ACGUGACCCAAGCUCGCAUGGUC | 1016 |

In Vitro Screening in BE(2)-C and Neuro-2a Cells i. Cell Culture and Transfections:

BE(2)-C(ATCC) were transfected by adding 5 µl of Opti-MEM plus 0.1 µl of Lipofectamine RNAimax per well (Invitrogen, Carlsbad CA. cat #13778-150) to 5 µl of siRNA duplexes per well, with 4 replicates of each siRNA duplex, into a 384-well plate, and incubated at room temperature for 15 minutes. Forty µl of 1:1 mixture of Minimum Essential Medium and F12 Medium (ThermoFisher) containing ~$5\times10^3$ cells were then added to the siRNA mixture. Cells were incubated for 24 hours prior to RNA purification.

Neuro-2a (ATCC) are transfected by adding 5 µl of Opti-MEM plus 0.1 µl of Lipofectamine RNAimax per well (Invitrogen, Carlsbad CA. cat #13778-150) to 5 µl of siRNA duplexes per well, with 4 replicates of each siRNA duplex, into a 384-well plate, and incubated at room temperature for 15 minutes. Forty µl of Minimum Essential Medium (ThermoFisher) containing ~$5\times10^3$ cells are then added to the siRNA mixture. Cells are incubated for 24 hours prior to RNA purification.

Typically, four dose experiments are performed at 50 nM, I0 nM 1 nM and 0.1 nM. In some instances, three dose experiments are performed at 10 nM, 1 nM and 0.1 nM. In other instances, two dose experiments are performed at 10 nM and 0.1 nM.

ii. Total RNA Isolation Using DYNABEADS mRNA Isolation Kit:

RNA was isolated using an automated protocol on a BioTek-EL406 platform using DYNABEADs (Invitrogen, cat #61012). Briefly, 70 ul of Lysis/Binding Buffer and 10 ul of lysis buffer containing 3 ul of magnetic beads were added to the plate with cells. Plates were incubated on an electromagnetic shaker for 10 minutes at room temperature and then magnetic beads were captured and the supernatant was removed. Bead-bound RNA was then washed 2 times with 150 ul Wash Buffer A and once with Wash Buffer B. Beads were then washed with 150 µl Elution Buffer, re-captured and supernatant removed.

iii. cDNA Synthesis Using ABI High Capacity cDNA Reverse Transcription Kit (Applied Biosystems, Foster City, CA, Cat #4368813):

Ten µl of a master mix containing 1 µl 10× Buffer, 0.4 ul 25×dNTPs, 1 µl 10× Random primers, 0.5 µl Reverse Transcriptase, 0.5 µl RNase inhibitor and 6.6 µl of H2O per reaction was added to RNA isolated above. Plates were sealed, mixed, and incubated on an electromagnetic shaker for 10 minutes at room temperature, followed by 2 h 37° C.

iv. Real Time PCR:

Two µl of cDNA and 5 µl Lightcycler 480 probe master mix (Roche Cat #04887301001) were added to either 0.5 µl of Human GAPDH TaqMan Probe (4326317E) and 0.5p human MAPT probe (hs00902194_m1, Thermo) or 0.5 µl Mouse GAPDH TaqMan Probe (4352339E) and 0.5 µl mouse MAPT probe (Mm00521988_m1, Thermo) per well in a 384 well plates (Roche cat #04887301001). Real time PCR was done in a LightCycler480 Real Time PCR system (Roche). Each duplex was tested at least two times and data was normalized to cells transfected with a non-targeting control siRNA. To calculate relative fold change, real time data was analyzed using the ΔΔCt method and normalized to assays performed with cells transfected with a non-targeting control siRNA.

v. Results:

The results of a triple dose screen in BE(2)-C cells are shown in Table 7. The experiments were performed at 10 nM, 1 nM, and 0.1 nM final duplex concentrations and the data are expressed as percent MAPT mRNA remaining relative to non-targeting control (GAPDH).

TABLE 7

In vitro screen of human MAPT siRNA

| Duplex | 10 nM Dose Avg % mRNA Remaining | 10 nM Dose SD | 1 nM Dose Avg % mRNA Remaining | 1 nM Dose SD | 0.1 nM Dose Avg % mRNA Remaining | 0.1 nM Dose SD |
|---|---|---|---|---|---|---|
| AD-1397070.3 | 56 | 13 | 63 | 19 | 102 | 21 |
| AD-1397072.4 | 24 | 3 | 41 | 11 | 68 | 6 |
| AD-1397073.4 | 44 | 21 | 63 | 32 | 85 | 10 |
| AD-1397075.3 | 72 | 21 | 99 | 23 | 106 | 27 |
| AD-1397081.4 | 23 | 7 | 37 | 6 | 61 | 11 |
| AD-1397083.4 | 24 | 8 | 52 | 15 | 71 | 9 |
| AD-1397088.3 | 28 | 7 | 32 | 3 | 44 | 6 |
| AD-1397249.2 | 57 | 17 | 48 | 12 | 75 | 20 |
| AD-1397252.3 | 27 | 5 | 29 | 5 | 67 | 15 |
| AD-1397252.4 | 25 | 5 | 39 | 10 | 71 | 9 |
| AD-1397253.2 | 63 | 16 | 70 | 18 | 112 | 15 |
| AD-1397258.3 | 36 | 12 | 35 | 10 | 61 | 7 |
| AD-1397261.2 | 71 | 44 | 37 | 10 | 89 | 26 |
| AD-1397262.2 | 46 | 18 | 68 | 16 | 106 | 26 |
| AD-1397263.3 | 79 | 48 | 38 | 3 | 84 | 22 |
| AD-1397291.2 | 28 | 5 | 32 | 9 | 79 | 15 |
| AD-1397293.3 | 18 | 3 | 31 | 7 | 44 | 4 |
| AD-1397294.3 | 47 | 32 | 28 | 6 | 67 | 12 |
| AD-1397295.2 | 25 | 6 | 33 | 5 | 70 | 11 |
| AD-1397298.3 | 20 | 4 | 35 | 6 | 59 | 9 |
| AD-1397299.3 | 27 | 10 | 24 | 6 | 34 | 7 |
| AD-1637732.1 | 44 | 23 | 46 | 10 | 76 | 12 |
| AD-1637733.1 | 63 | 35 | 66 | 2 | 91 | 7 |
| AD-1637734.1 | 70 | 25 | 46 | 6 | 71 | 14 |
| AD-1637735.1 | 76 | 21 | 41 | 11 | 47 | 7 |
| AD-1637736.1 | 63 | 14 | 45 | 8 | 69 | 16 |
| AD-1637737.1 | 81 | 16 | 75 | 15 | 85 | 5 |
| AD-1637739.1 | 79 | 35 | 41 | 10 | 76 | 23 |
| AD-1637744.1 | 80 | 18 | 53 | 7 | 83 | 12 |
| AD-1637745.1 | 24 | 7 | 43 | 7 | 62 | 10 |
| AD-1637746.1 | 24 | 10 | 42 | 9 | 51 | 5 |
| AD-1637747.1 | 23 | 9 | 33 | 4 | 66 | 10 |
| AD-1637748.1 | 24 | 6 | 40 | 14 | 63 | 11 |
| AD-1637749.1 | 23 | 7 | 36 | 11 | 53 | 18 |
| AD-1637750.1 | 23 | 3 | 46 | 7 | 65 | 6 |
| AD-1637751.1 | 30 | 14 | 28 | 10 | 51 | 9 |
| AD-1637752.1 | 26 | 6 | 48 | 8 | 61 | 5 |
| AD-1637753.1 | 25 | 5 | 46 | 11 | 61 | 13 |
| AD-1637754.1 | 24 | 7 | 54 | 8 | 68 | 7 |
| AD-1637755.1 | 29 | 8 | 53 | 10 | 71 | 17 |
| AD-1637756.1 | 32 | 6 | 55 | 12 | 70 | 10 |
| AD-1637757.1 | 28 | 5 | 49 | 15 | 62 | 9 |
| AD-1637758.1 | 22 | 4 | 40 | 11 | 61 | 15 |
| AD-1637759.1 | 28 | 3 | 43 | 9 | 64 | 20 |
| AD-1637760.1 | 19 | 5 | 28 | 9 | 47 | 6 |
| AD-1637761.1 | 34 | 8 | 59 | 20 | 65 | 6 |
| AD-1637762.1 | 21 | 4 | 32 | 5 | 49 | 5 |
| AD-1637763.1 | 26 | 8 | 44 | 5 | 64 | 15 |

TABLE 7-continued

In vitro screen of human MAPT siRNA

| Duplex | 10 nM Dose Avg % mRNA Remaining | 10 nM Dose SD | 1 nM Dose Avg % mRNA Remaining | 1 nM Dose SD | 0.1 nM Dose Avg % mRNA Remaining | 0.1 nM Dose SD |
|---|---|---|---|---|---|---|
| AD-1637764.1 | 28 | 8 | 57 | 21 | 75 | 9 |
| AD-1637765.1 | 25 | 6 | 46 | 13 | 61 | 13 |
| AD-1637766.1 | 26 | 3 | 49 | 3 | 73 | 10 |
| AD-1637767.1 | 20 | 3 | 32 | 3 | 45 | 4 |
| AD-1637768.1 | 24 | 5 | 39 | 12 | 61 | 6 |
| AD-1637769.1 | 46 | 3 | 46 | 5 | 72 | 6 |
| AD-1637770.1 | 22 | 2 | 50 | 9 | 64 | 8 |
| AD-1637771.1 | 37 | 2 | 68 | 11 | 68 | 6 |
| AD-1637772.1 | 33 | 6 | 65 | 25 | 83 | 15 |
| AD-1637773.1 | 48 | 6 | 97 | 28 | 85 | 8 |
| AD-1637774.1 | 17 | 7 | 36 | 8 | 51 | 8 |
| AD-1637775.1 | 37 | 7 | 69 | 10 | 80 | 11 |
| AD-1637776.1 | 24 | 6 | 54 | 8 | 63 | 21 |
| AD-1637777.1 | 17 | 3 | 31 | 5 | 42 | 3 |
| AD-1637778.1 | 36 | 11 | 82 | 9 | 70 | 17 |
| AD-1637779.1 | 22 | 4 | 50 | 6 | 66 | 4 |
| AD-1637780.1 | 23 | 9 | 34 | 9 | 57 | 14 |
| AD-1637781.1 | 26 | 7 | 42 | 4 | 61 | 10 |
| AD-1637782.1 | 28 | 3 | 46 | 11 | 64 | 13 |
| AD-1637783.1 | 25 | 4 | 61 | 5 | 70 | 11 |
| AD-1637784.1 | 32 | 8 | 56 | 18 | 75 | 17 |
| AD-1637785.1 | 69 | 13 | 87 | 13 | 78 | 4 |
| AD-1637786.1 | 46 | 23 | 56 | 5 | 77 | 16 |
| AD-1637787.1 | 55 | 8 | 90 | 8 | 83 | 10 |
| AD-1637788.1 | 26 | 5 | 50 | 16 | 68 | 17 |
| AD-1637789.1 | 48 | 9 | 71 | 15 | 75 | 10 |
| AD-1637790.1 | 22 | 5 | 45 | 6 | 63 | 3 |
| AD-1637791.1 | 25 | 8 | 49 | 13 | 70 | 14 |
| AD-1637792.1 | 29 | 2 | 66 | 14 | 71 | 21 |
| AD-1637793.1 | 17 | 3 | 23 | 8 | 45 | 11 |
| AD-1637794.1 | 23 | 4 | 27 | 4 | 46 | 14 |
| AD-1637795.1 | 24 | 3 | 56 | 8 | 74 | 12 |
| AD-1637796.1 | 21 | 5 | 53 | 13 | 60 | 13 |
| AD-1637797.1 | 20 | 3 | 39 | 12 | 50 | 5 |
| AD-1637798.1 | 24 | 7 | 41 | 4 | 52 | 8 |
| AD-1637799.1 | 23 | 6 | 53 | 19 | 73 | 9 |
| AD-1637800.1 | 63 | 9 | 79 | 20 | 82 | 28 |
| AD-1637801.1 | 34 | 6 | 64 | 16 | 73 | 14 |
| AD-1637802.1 | 32 | 8 | 55 | 24 | 68 | 16 |
| AD-1637803.1 | 32 | 7 | 55 | 12 | 82 | 15 |
| AD-1637804.1 | 27 | 7 | 47 | 7 | 63 | 15 |
| AD-1637805.1 | 28 | 5 | 60 | 9 | 74 | 20 |
| AD-1637806.1 | 22 | 8 | 22 | 5 | 50 | 9 |
| AD-1637806.2 | 22 | 5 | 31 | 3 | 55 | 9 |
| AD-1637807.1 | 15 | 5 | 21 | 3 | 35 | 4 |
| AD-1637808.1 | 18 | 6 | 35 | 13 | 55 | 21 |
| AD-1637809.1 | 59 | 10 | 111 | 29 | 100 | 9 |
| AD-1637810.1 | 37 | 6 | 64 | 20 | 71 | 15 |
| AD-1637811.1 | 26 | 6 | 65 | 6 | 70 | 6 |
| AD-1637812.1 | 21 | 3 | 35 | 7 | 56 | 11 |
| AD-1637813.1 | 39 | 15 | 65 | 26 | 79 | 8 |
| AD-1637814.1 | 33 | 5 | 51 | 10 | 73 | 3 |
| AD-1637815.1 | 35 | 5 | 56 | 12 | 71 | 12 |
| AD-1637816.1 | 58 | 17 | 58 | 15 | 82 | 16 |
| AD-1637817.1 | 50 | 8 | 78 | 12 | 78 | 7 |
| AD-1637818.1 | 43 | 10 | 80 | 24 | 87 | 26 |
| AD-1637819.1 | 78 | 7 | 105 | 23 | 83 | 23 |
| AD-1637820.1 | 76 | 16 | 100 | 11 | 72 | 18 |
| AD-1637821.1 | 68 | 3 | 104 | 33 | 77 | 14 |
| AD-1637822.1 | 48 | 10 | 92 | 12 | 84 | 13 |
| AD-1637823.1 | 27 | 10 | 63 | 13 | 79 | 24 |
| AD-1637824.1 | 69 | 24 | 112 | 23 | 90 | 6 |
| AD-1637825.1 | 40 | 10 | 79 | 19 | 76 | 17 |
| AD-1637826.1 | 64 | 13 | 105 | 33 | 78 | 31 |
| AD-1637827.1 | 31 | 4 | 65 | 25 | 76 | 24 |
| AD-1637828.1 | 58 | 4 | 103 | 28 | 74 | 15 |
| AD-1637829.1 | 29 | 2 | 45 | 18 | 66 | 5 |
| AD-1637830.1 | 77 | 31 | 76 | 14 | 81 | 25 |
| AD-1637831.1 | 21 | 9 | 27 | 3 | 35 | 12 |
| AD-1637832.1 | 33 | 5 | 23 | 9 | 38 | 9 |
| AD-1637833.1 | 49 | 13 | 48 | 17 | 61 | 18 |
| AD-1637834.1 | 70 | 24 | 80 | 15 | 72 | 9 |

TABLE 7-continued

In vitro screen of human MAPT siRNA

| Duplex | 10 nM Dose Avg % mRNA Remaining | 10 nM Dose SD | 1 nM Dose Avg % mRNA Remaining | 1 nM Dose SD | 0.1 nM Dose Avg % mRNA Remaining | 0.1 nM Dose SD |
|---|---|---|---|---|---|---|
| AD-1637835.1 | 29 | 6 | 37 | 6 | 60 | 7 |
| AD-1637836.1 | 37 | 3 | 48 | 13 | 70 | 5 |
| AD-1637837.1 | 35 | 2 | 42 | 3 | 54 | 12 |
| AD-1637838.1 | 26 | 15 | 34 | 4 | 56 | 6 |
| AD-1637839.1 | 24 | 6 | 34 | 3 | 55 | 6 |
| AD-1637840.1 | 25 | 3 | 37 | 9 | 51 | 10 |
| AD-1637841.1 | 30 | 14 | 26 | 6 | 54 | 6 |
| AD-1637842.1 | 39 | 18 | 56 | 13 | 63 | 11 |
| AD-1637843.1 | 31 | 8 | 46 | 11 | 56 | 11 |
| AD-1637844.1 | 26 | 15 | 26 | 9 | 45 | 5 |
| AD-1637845.1 | 24 | 12 | 44 | 13 | 54 | 17 |
| AD-1637846.1 | 39 | 4 | 57 | 15 | 67 | 12 |
| AD-1637847.1 | 48 | 23 | 43 | 12 | 78 | 10 |
| AD-1637848.1 | 33 | 5 | 46 | 14 | 58 | 11 |
| AD-1637849.1 | 44 | 9 | 75 | 7 | 73 | 4 |
| AD-1637850.1 | 59 | 20 | 85 | 17 | 82 | 10 |
| AD-1637851.1 | 41 | 11 | 62 | 20 | 68 | 6 |
| AD-1637852.1 | 37 | 12 | 34 | 6 | 53 | 6 |
| AD-1637853.1 | 51 | 16 | 75 | 8 | 79 | 14 |
| AD-1637854.1 | 45 | 10 | 61 | 7 | 71 | 6 |
| AD-1637855.1 | 26 | 9 | 34 | 10 | 56 | 8 |
| AD-1637856.1 | 56 | 20 | 72 | 16 | 86 | 15 |
| AD-1637857.1 | 63 | 24 | 62 | 12 | 85 | 8 |
| AD-1637858.1 | 101 | 24 | 80 | 16 | 100 | 17 |
| AD-1637859.1 | 71 | 27 | 86 | 12 | 87 | 9 |
| AD-1637860.1 | 48 | 6 | 56 | 8 | 78 | 11 |
| AD-1637861.1 | 26 | 7 | 23 | 3 | 40 | 8 |
| AD-1637862.1 | 41 | 3 | 38 | 5 | 60 | 9 |
| AD-1637863.1 | 33 | 7 | 32 | 5 | 53 | 9 |
| AD-1637864.1 | 26 | 4 | 33 | 12 | 44 | 10 |
| AD-1637865.1 | 35 | 10 | 38 | 16 | 59 | 5 |
| AD-1637866.1 | 41 | 5 | 73 | 13 | 77 | 27 |
| AD-1637867.1 | 40 | 5 | 58 | 8 | 74 | 18 |
| AD-1637868.1 | 37 | 12 | 43 | 12 | 57 | 15 |
| AD-1637869.1 | 77 | 15 | 51 | 3 | 51 | 6 |
| AD-1637870.1 | 88 | 21 | 48 | 10 | 62 | 6 |
| AD-1637871.1 | 65 | 8 | 49 | 4 | 52 | 9 |
| AD-1637872.1 | 54 | 11 | 56 | 4 | 56 | 12 |
| AD-1637873.1 | 86 | 33 | 52 | 9 | 56 | 7 |
| AD-1637874.1 | 99 | 33 | 55 | 6 | 65 | 3 |
| AD-1637875.1 | 95 | 50 | 89 | 20 | 78 | 18 |
| AD-1637876.1 | 104 | 23 | 70 | 10 | 93 | 6 |
| AD-1637877.1 | 100 | 29 | 85 | 8 | 76 | 20 |
| AD-1637878.1 | 30 | 5 | 35 | 7 | 62 | 8 |
| AD-1637879.1 | 25 | 15 | 35 | 5 | 58 | 8 |
| AD-1637880.1 | 32 | 7 | 45 | 6 | 60 | 2 |
| AD-1637881.1 | 23 | 8 | 29 | 2 | 47 | 3 |
| AD-1637882.1 | 24 | 4 | 29 | 9 | 52 | 8 |
| AD-1637883.1 | 27 | 4 | 32 | 3 | 44 | 12 |
| AD-1637884.1 | 26 | 5 | 49 | 14 | 55 | 16 |
| AD-1637885.1 | 26 | 9 | 47 | 5 | 65 | 10 |
| AD-1637886.1 | 31 | 7 | 29 | 5 | 58 | 7 |
| AD-1637887.1 | 23 | 8 | 34 | 8 | 56 | 2 |
| AD-1637888.1 | 31 | 12 | 36 | 6 | 68 | 11 |
| AD-1637889.1 | 30 | 10 | 43 | 4 | 53 | 5 |
| AD-1637890.1 | 69 | 33 | 82 | 19 | 84 | 4 |
| AD-1637891.1 | 65 | 27 | 78 | 16 | 71 | 7 |
| AD-1637892.1 | 46 | 14 | 60 | 10 | 91 | 15 |
| AD-1637893.1 | 48 | 21 | 49 | 7 | 96 | 17 |
| AD-1637894.1 | 43 | 36 | 51 | 18 | 86 | 27 |
| AD-1637895.1 | 52 | 30 | 35 | 2 | 82 | 11 |
| AD-1637896.1 | 84 | 26 | 92 | 26 | 102 | 27 |
| AD-1637897.1 | 80 | 8 | 88 | 22 | 112 | 13 |
| AD-1637898.1 | 87 | 17 | 83 | 8 | 95 | 21 |
| AD-1637899.1 | 28 | 3 | 35 | 10 | 73 | 9 |
| AD-1637900.1 | 43 | 6 | 65 | 11 | 98 | 8 |
| AD-1637901.1 | 71 | 18 | 82 | 11 | 106 | 21 |
| AD-1637902.1 | 78 | 23 | 94 | 17 | 117 | 21 |
| AD-1637903.1 | 42 | 23 | 36 | 2 | 81 | 23 |
| AD-1637904.1 | 37 | 10 | 51 | 9 | 84 | 8 |
| AD-1637905.1 | 34 | 10 | 46 | 6 | 94 | 24 |
| AD-1637906.1 | 82 | 40 | 103 | 16 | 118 | 24 |
| AD-1637907.1 | 18 | 7 | 27 | 9 | 50 | 4 |
| AD-1637908.1 | 106 | 28 | 98 | 16 | 107 | 15 |
| AD-1637909.1 | 62 | 22 | 74 | 11 | 86 | 6 |
| AD-1637910.1 | 58 | 54 | 39 | 9 | 85 | 13 |
| AD-1637911.1 | 61 | 30 | 91 | 11 | 95 | 18 |
| AD-1637912.1 | 45 | 49 | 28 | 4 | 69 | 3 |
| AD-1637913.1 | 47 | 38 | 32 | 7 | 66 | 8 |
| AD-1637914.1 | 50 | 45 | 44 | 3 | 79 | 6 |
| AD-1637915.1 | 35 | 19 | 43 | 7 | 101 | 9 |
| AD-1637916.1 | 57 | 20 | 79 | 11 | 99 | 13 |
| AD-1637917.1 | 70 | 27 | 49 | 6 | 84 | 21 |
| AD-1637918.1 | 29 | 8 | 42 | 8 | 79 | 12 |
| AD-1637919.1 | 52 | 30 | 84 | 6 | 127 | 49 |
| AD-1637920.1 | 62 | 28 | 58 | 6 | 100 | 14 |
| AD-1637921.1 | 57 | 9 | 56 | 14 | 104 | 35 |
| AD-1637922.1 | 19 | 4 | 25 | 6 | 58 | 10 |
| AD-1637923.1 | 39 | 25 | 43 | 5 | 79 | 13 |
| AD-1637924.1 | 67 | 11 | 88 | 39 | 111 | 12 |
| AD-1637925.1 | 29 | 25 | 27 | 4 | 60 | 5 |
| AD-1637926.1 | 37 | 22 | 33 | 6 | 82 | 15 |
| AD-1637927.1 | 53 | 34 | 73 | 21 | 95 | 16 |
| AD-1637928.1 | 47 | 22 | 52 | 10 | 101 | 15 |
| AD-1637929.1 | 33 | 14 | 46 | 18 | 100 | 22 |
| AD-1637930.1 | 37 | 16 | 57 | 9 | 84 | 12 |
| AD-1637931.1 | 54 | 24 | 61 | 10 | 98 | 17 |
| AD-1637932.1 | 23 | 3 | 26 | 7 | 66 | 12 |
| AD-1637933.1 | 49 | 39 | 24 | 7 | 52 | 13 |
| AD-1637934.1 | 74 | 10 | 82 | 26 | 116 | 5 |
| AD-1637935.1 | 37 | 8 | 58 | 13 | 97 | 18 |
| AD-1637936.1 | 32 | 4 | 37 | 13 | 81 | 18 |
| AD-1637937.1 | 31 | 7 | 28 | 5 | 76 | 9 |
| AD-1637938.1 | 37 | 22 | 39 | 16 | 91 | 5 |
| AD-1637939.1 | 87 | 15 | 81 | 14 | 104 | 15 |
| AD-1637940.1 | 36 | 9 | 44 | 12 | 98 | 12 |
| AD-1637941.1 | 30 | 7 | 50 | 11 | 79 | 11 |
| AD-1637942.1 | 20 | 9 | 32 | 5 | 82 | 10 |
| AD-1637943.1 | 25 | 3 | 38 | 4 | 75 | 10 |
| AD-1637944.1 | 37 | 31 | 42 | 7 | 77 | 22 |
| AD-1637945.1 | 59 | 22 | 88 | 30 | 102 | 13 |
| AD-1637946.1 | 21 | 9 | 30 | 6 | 63 | 7 |
| AD-1637947.1 | 35 | 8 | 34 | 13 | 57 | 12 |
| AD-1637948.1 | 79 | 31 | 86 | 17 | 119 | 19 |
| AD-1637949.1 | 69 | 33 | 76 | 20 | 110 | 28 |
| AD-1637950.1 | 49 | 30 | 35 | 14 | 73 | 12 |
| AD-1637951.1 | 51 | 49 | 35 | 12 | 71 | 14 |
| AD-1637952.1 | 32 | 9 | 45 | 12 | 95 | 29 |
| AD-1637953.1 | 52 | 6 | 38 | 5 | 57 | 5 |
| AD-1637954.1 | 73 | 16 | 49 | 1 | 74 | 16 |
| AD-1637955.1 | 106 | 13 | 84 | 20 | 79 | 8 |
| AD-1637956.1 | 53 | 17 | 54 | 11 | 78 | 24 |
| AD-1637957.1 | 66 | 14 | 83 | 10 | 117 | 6 |
| AD-1637958.1 | 48 | 20 | 49 | 9 | 70 | 7 |
| AD-1637959.1 | 49 | 11 | 52 | 3 | 74 | 21 |
| AD-1637960.1 | 48 | 22 | 54 | 12 | 79 | 27 |
| AD-397167.5 | 81 | 22 | 52 | 7 | 47 | 8 |
| AD-523565.3 | 20 | 7 | 28 | 5 | 45 | 3 |

Example 2. In Vivo Evaluation in Transgenic Mice

This Example describes methods for the in vivo evaluation of MAPT RNAi agents in transgenic mice expressing human MAPT RNAs.

The ability of selected dsRNA agents designed and assayed in Example 1 was assessed for their ability to reduce the level of both sense- or antisense-containing foci in mice expressing human MAPT RNAs.

Briefly, duplexes of interest, identified from the above in vitro studies and shown in Table 4, were evaluated in vivo. In particular, at pre-dose day 14 wild-type, 8 week old female mice (C57BL/6) were transduced by retroorbital administration of $2 \times 10^{10}$ genome copies of AAV that expresses a portion of the human MAPT gene. In particular, mice were administered an AAV encoding the entirety of human MAPT gene coding sequence (323-1648) and part of 3'UTR (4473-5811) of NM_016841.4, cloned in it.

Two weeks later and at day 0, the mice were administered subcutaneously a single dose of one of the dsRNA agents of interest at 3 mg/Kg, a single dose of a non-targeting dsRNA agent (AD-64958.114) at 3 mg/Kg (negative control), or PBS control. Two weeks' post-duplex dosing and at day 14, animals were sacrificed, liver samples were collected and snap-frozen in liquid nitrogen. Tissue mRNA was extracted and analyzed by the RT-QPCR method for human MAPT expression.

Human MAPT mRNA levels were compared to housekeeping gene GAPDH. The values were then normalized to the average of PBS vehicle control group. The data were expressed as percent of baseline value, and presented as mean plus standard deviation. The results, listed in Table 8 and shown in FIG. 1, demonstrate that the exemplary duplex agents tested effectively reduce the level of the human MAPT mRNA in vivo.

TABLE 8

In Vivo Results

| Treatment Group | Avg | SD |
|---|---|---|
| PBS | 100.0 | 51.8 |
| AD-64958.114 | 89.3 | 23.9 |
| AD-1637922.2 | 21.9 | 17.6 |
| AD-1637806.3 | 43.0 | 26.4 |
| AD-1637762.2 | 25.5 | 2.8 |
| AD-1637777.2 | 29.3 | 4.5 |
| AD-1637779.2 | 85.2 | 31.7 |
| AD-1397081.5 | 24.5 | 19.0 |
| AD-1637793.2 | 32.3 | 9.2 |
| AD-1637798.2 | 41.3 | 13.2 |
| AD-1637807.2 | 29.3 | 12.5 |
| AD-1637829.2 | 81.7 | 21.8 |
| AD-1637831.2 | 22.6 | 15.0 |
| AD-1637840.2 | 53.1 | 11.8 |
| AD-1637841.2 | 78.3 | 22.6 |
| AD-1637855.2 | 81.0 | 36.6 |
| AD-1637883.2 | 8.8 | 10.5 |
| AD-1637884.2 | 109.9 | 66.3 |

Example 3. Off-Target Characterization i. Experimental Methods

This Example describes methods for the in vitro characterization of off-target effects of MAPT RNAi. Briefly, Be(2)-C cells (ATCC, Manassas VA, Cat #CRL-2268) were transfected in 384-well plates (5000 cells per well) with siRNA or DPBS (mock control) at a final concentration of 10 nM using Invitrogen Lipofectamine® RNAiMAX (Invitrogen, Carlsbad, CA, Catalog No. 13778-150). After 24 hours, cell were lysed in lysis buffer (Tris HCl pH 7.5 100 mM, LiCl 500 mM, EDTA pH 8.0 10 mM, LiDS 1%, DTT 5 mM supplemented with TURBO™ DNase, Thermofisher #AM2238) for 30 min. Subsequently whole transcriptome mRNA-enriched RNA-Seq libraries were constructed from cell lysates using a KAPA mRNA Capture Kit and mRNA HyperPrep Kit (Roche) as per protocol but in 5× miniaturized reagent scale and with mRNA capture beads resuspended in water prior to mix with lysate. RNA-Seq libraries were quantified by low depth sequencing on an Illumina® iSeq sequencing instrument. Equal amounts of each library/sample were pooled and sequenced on an Illumina® NovaSeq sequencing instrument with 2×150 bp paired-end settings, according to manufacturers' instructions.

Raw RNAseq reads were filtered with minimal mean quality scores of 28 and minimal remaining length of 36, using the ea-utils software fastq-mcfv 1.05. See, Aronesty, E. (2011) ea-utils: "Command-line tools for processing biological sequencing data." Filtered reads were aligned to the *Homo sapiens* genome (GRCh38) using STAR (ultrafast universal RNAseq aligner) v2.7.9a. See, Dobin, et al., Bioinformatics. 2013 Jan. 1; 29(1):15-21. Uniquely aligned reads were counted by featureCounts v2.0.2, see, Liao, et al., Bioinformatics. 2014 Apr. 1; 30(7):923-30, with the minimum mapping quality score set to 10. Differential gene expression analysis was performed by the R package DESeq2 v1.34.0 with the betaPrior parameter set to TRUE to shrink $\log_2$ fold-change estimates for noisy, low-count genes. See, Genome Biol. 2014; 15(12):550.

ii. Results

The results, listed in Table 9 below and shown in FIGS. 2A1-2A6 and 2B1-2B6, demonstrate the effects of various mismatches in the seed region of the antisense strand on off-target genes. The duplexes in Table 9 and FIGS. 2A1-2A6 and 2B1-2B6 each target the same region of the same MAPT mRNA transcript. The duplexes in FIGS. 2A1-2A6 have different chemical modifications than the duplexes in FIGS. 2B1-2B6. Duplexes AD-1637760 (FIGS. 2A1-2A2) and AD-1637763 (FIGS. 2B1-2B2) comprise antisense strands having fully MAPT mRNA-matched seed regions (nucleotide positions 2-8 as counted from the 5' end of the antisense strand). Duplexes AD-1637761 (FIGS. 2A3-2A4) and AD-1637764 (FIGS. 2B3-2B4) comprise antisense strands having a nucleotide mismatch (MM) relative to the target MAPT mRNA only at position 6. Duplexes AD-1637762 (FIGS. 2A5-2A6) and AD-1637765 (FIGS. 2B5-2B6) comprise antisense strands having a nucleotide mismatch relative to the target MAPT mRNA only at position 7. As can be seen in FIGS. 2A1-2A6 and 2B1-2B6, the fully matched duplexes exhibit effective knockdown but relatively noisy off-target effects, particularly in genes having canonical seed matches (open squares and dark grey dots).

TABLE 9

Off-Target Effects

| | | On-Target | CDF Shift | | | DEGs | | |
|---|---|---|---|---|---|---|---|---|
| Duplex | MM | (% KD) | mer8 | mer7(m8) | mer7(A1) | Total Up | Total Down | Total DEGs |
| AD-1637760 | None | −77% | −0.086 | −0.029 | −0.007 | 43 | 100 | 143 |
| AD-1637761 | 6 | −74% | −0.055 | −0.037 | 0.01 | 6 | 45 | 51 |
| AD-1637762 | 7 | −79% | −0.041 | −0.01 | 0.014 | 9 | 36 | 45 |

TABLE 9-continued

| Off-Target Effects | | | | | | | | |
|---|---|---|---|---|---|---|---|---|
| | | On- | | | | DEGs | | |
| | | Target | CDF Shift | | | Total | Total | Total |
| Duplex | MM | (% KD) | mer8 | mer7(m8) | mer7(A1) | Up | Down | DEGs |
| AD-1637763 | None | −81% | −0.076 | −0.024 | −0.004 | 11 | 39 | 50 |
| AD-1637764 | 6 | −77% | −0.08 | −0.045 | −0.002 | 6 | 47 | 53 |
| AD-1637765 | 7 | −82% | −0.039 | −0.012 | 0.006 | 0 | 6 | 6 |

TABLE 10

| In vitro Dose Response (% mRNA Remaining) | | | | | | | |
|---|---|---|---|---|---|---|---|
| Duplex | MM | 10 nM Avg | SD | 1 nM Avg | SD | 0.1 nM Avg | SD |
| AD-1637760 | None | 19.0 | 5.5 | 27.6 | 8.5 | 46.8 | 6.5 |
| AD-1637761 | 6 | 33.7 | 7.7 | 58.5 | 19.6 | 65.2 | 5.6 |
| AD-1637762 | 7 | 21.3 | 3.7 | 32.1 | 5.3 | 49.2 | 5.2 |
| AD-1637763 | None | 26.1 | 7.9 | 44.1 | 4.6 | 64.5 | 15.4 |
| AD-1637764 | 6 | 27.6 | 8.0 | 56.6 | 20.8 | 75.0 | 9.1 |
| AD-1637765 | 7 | 24.5 | 5.8 | 45.9 | 13.0 | 60.8 | 13.1 |

Example 4. In Vivo Evaluation in Non-Human Primates (NHP)

i. Experimental Methods

The study design is shown in Table 11 below. Cynomolgus monkeys were administered a single dose of 60 mg of an siRNA agent conjugated to a C16 moiety or artificial cerebrospinal fluid (aCSF) by intrathecal injections via L4-L5. Serial CSF and blood collections were made at baseline (pre-dose) and various time points thereafter for biomarker analysis. The experiment was terminated either after D29 or D113 post dose and the brains were collected and snap-frozen in liquid nitrogen. Tau protein and mRNA levels were measured in CNS tissue, including the cortex (prefrontal/temporal), hippocampus, thalamus, midbrain, pons, and remaining brain stem, cerebellum, and striatum separated to caudate and putamen/globus pallidus, as well as liver, kidney, and muscle tissue. Tissue mRNA was extracted and analyzed by the RT-QPCR as described above. Group mean values were normalized to the mean value for the aCSF treated group. Levels within the cortex (prefrontal/temporal), hippocampus, midbrain, and putamen/globus pallidus were used to gate for candidate drug selection.

TABLE 11

| Study Design for brain delivery in NHP | | | | |
|---|---|---|---|---|
| Group | Number of Animals (n) | Test Article | Dose | Termination Date |
| 1 | 3 | aCSF | N/A | Day 29 |
| 2 | 5 | AD-1623140 | Single Dose (60 mg) | Day 29 |
| 3 | 5 | AD-1786708 | Single Dose (60 mg) | Day 29 |
| 4 | 5 | AD-1637701 | Single Dose (60 mg) | Day 29 |
| 5 | 3 | aCSF | N/A | Day 113 |
| 6 | 5 | AD-1623140 | Single Dose (60 mg) | Day 113 |
| 7 | 5 | AD-1786708 | Single Dose (60 mg) | Day 113 |
| 8 | 5 | AD-1637701 | Single Dose (60 mg) | Day 113 |

ii. Results

Figure 3A:
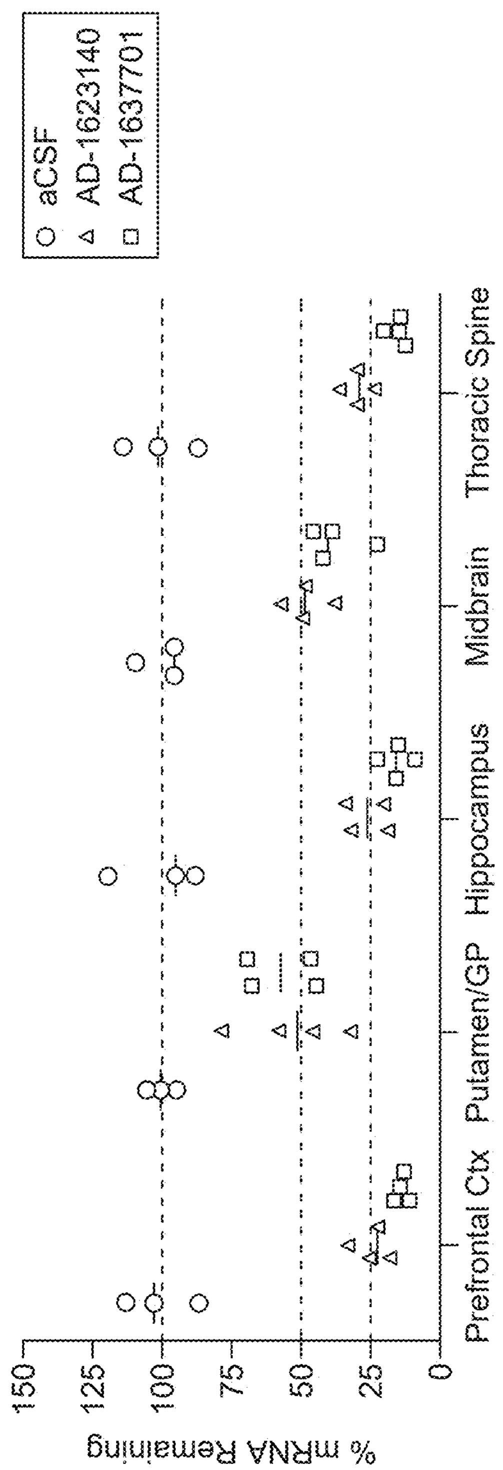
FIGS. 3A-3B show the NHP screen in various tissues at day 29 post treatment with respect to effect on MAPT mRNA expression, relative to treatment with aCSF.
Figure 3B:
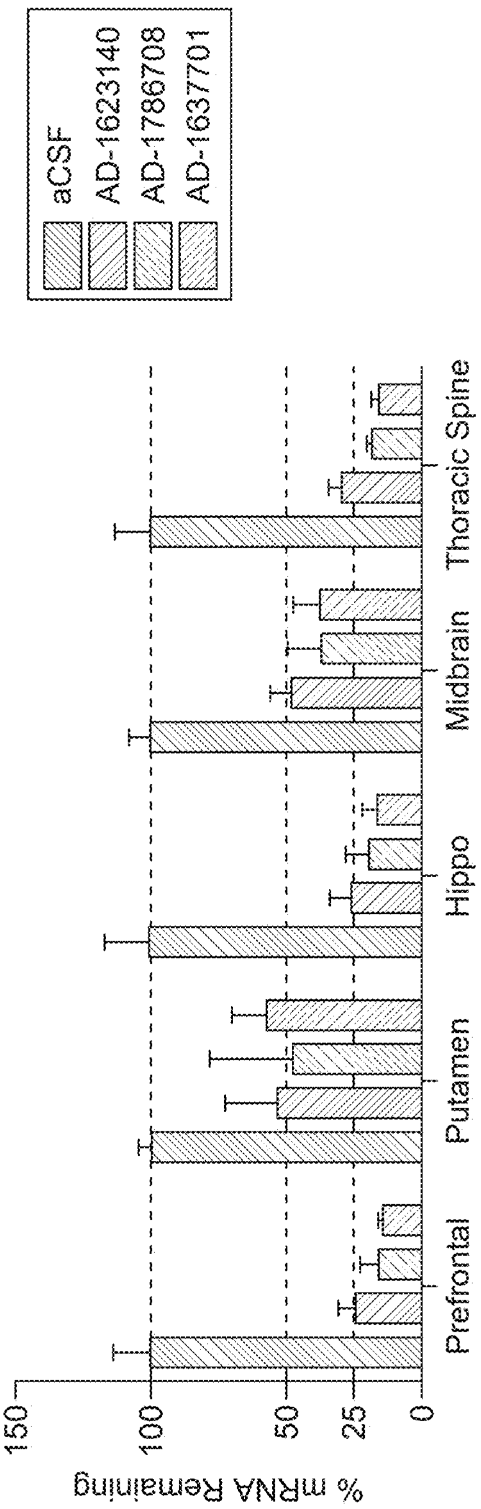
Figure 4A:
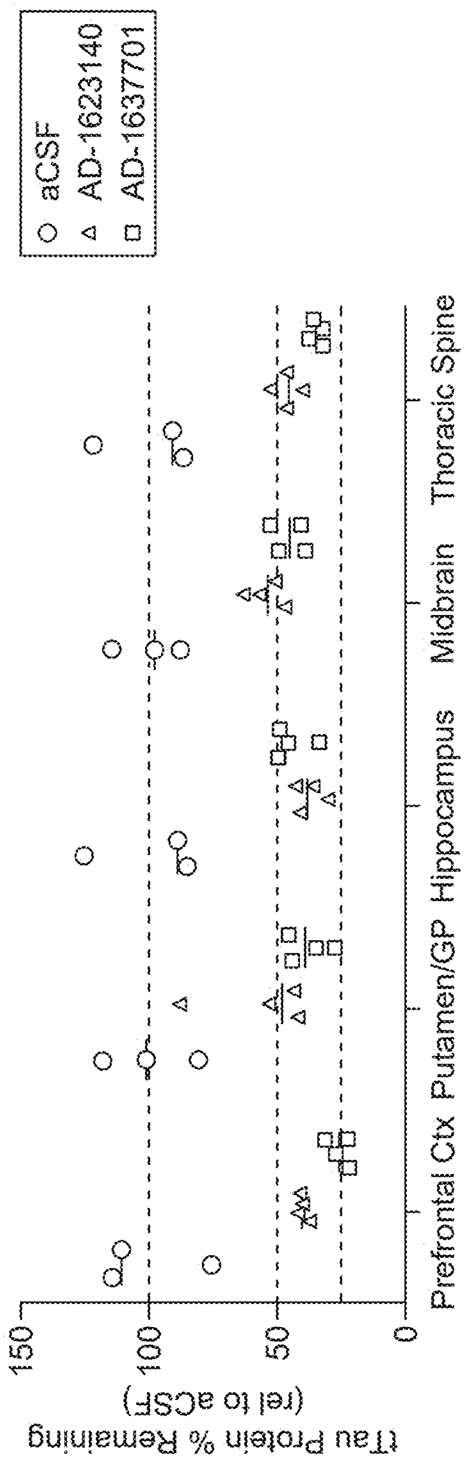
FIGS. 4A-4B show the NHP screen in various tissues at day 29 post treatment with respect to effect on tau protein expression, relative to treatment with aCSF.
Figure 4B:
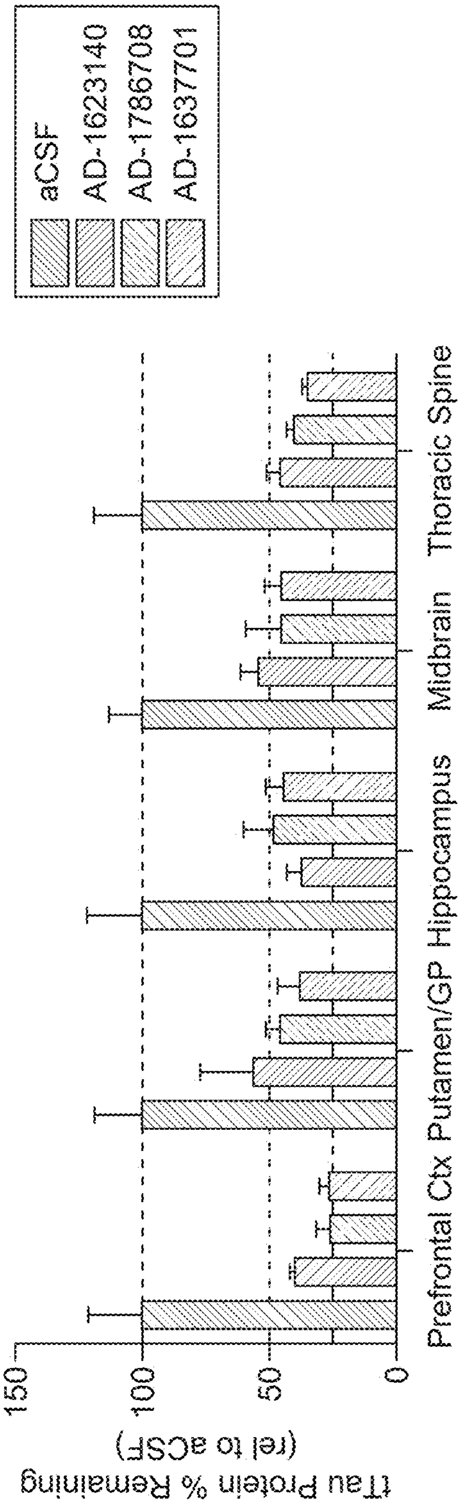
Figure 5:
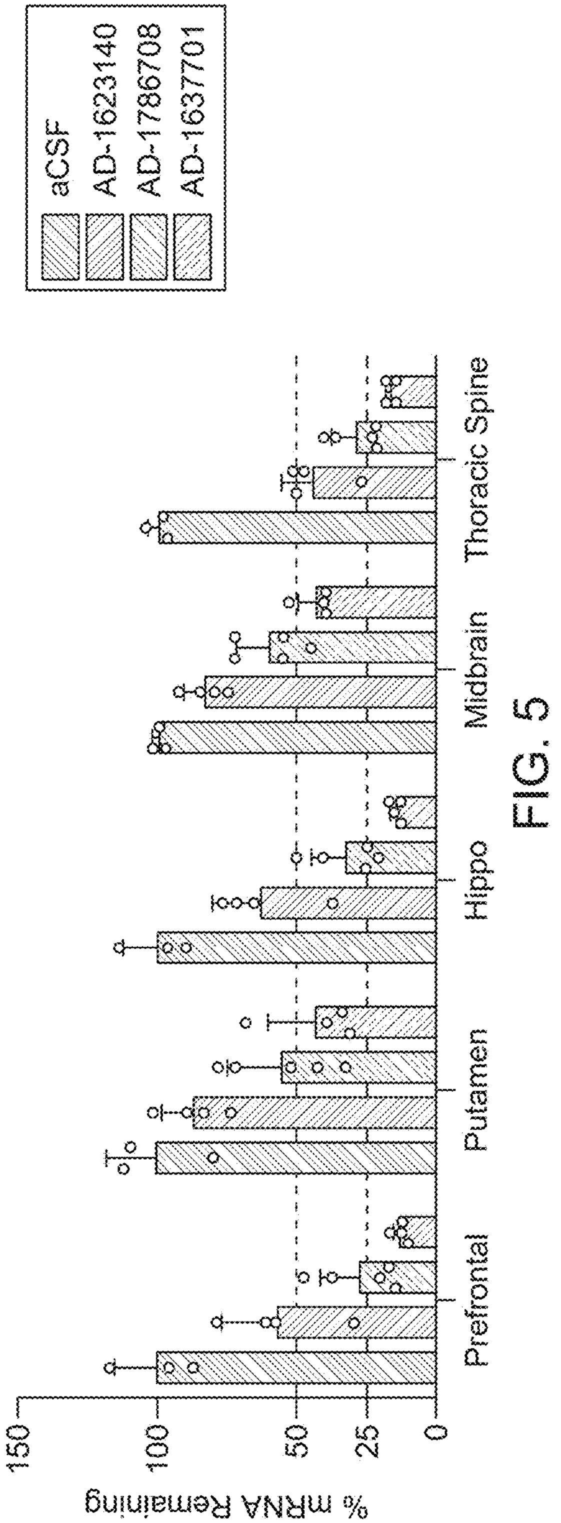
FIG. 5 shows the NHP screen in various tissues at day 113 post treatment with respect to effect on MAPT mRNA expression, relative to treatment with aCSF.
Figure 6:
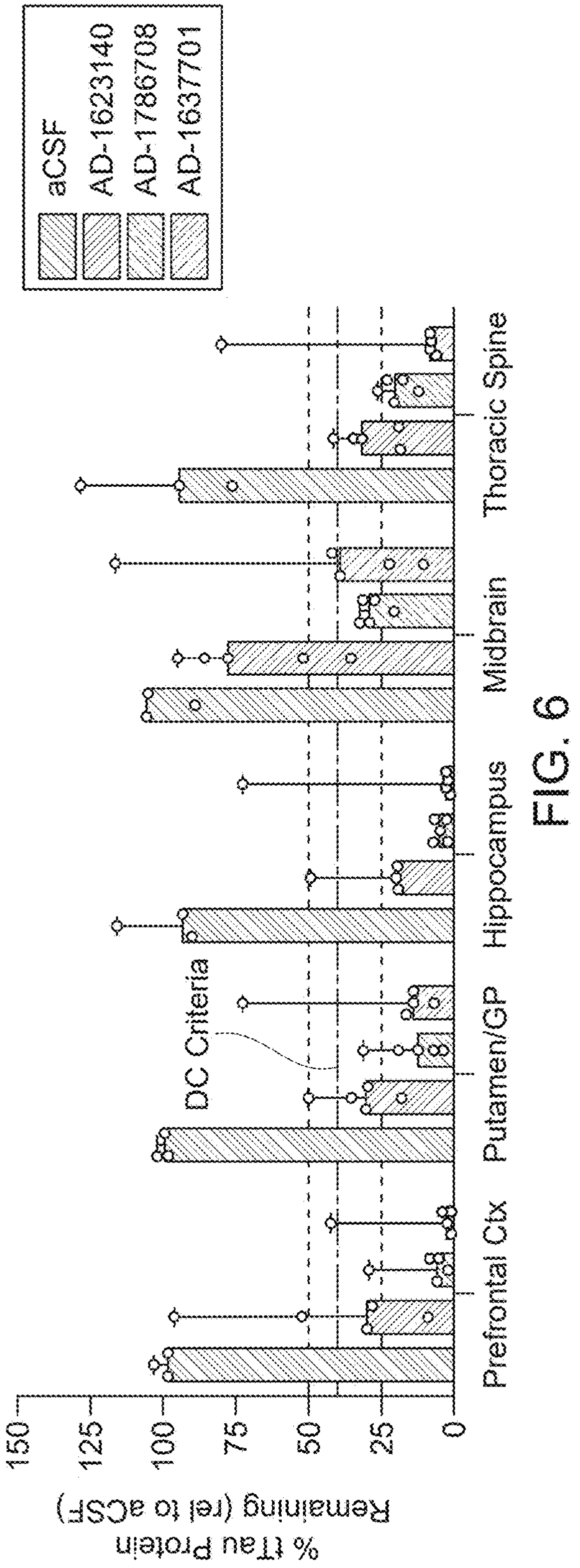

One of the animals from each of groups 4, 6 and 8 was determined to have only received a partial dose and so the data for these animals were removed from the subsequent data analysis. The d29 MAPT mRNA results (% mRNA remaining relative to the aCSF group) in various tissues are shown in FIGS. 3A and 3B and summarized in Table 12 below. The d29 tau protein results (% remaining relative to the aCSF group) in various tissues are shown in FIGS. 4A and 4B and summarized in Table 13 below. The d113 MAPT mRNA results (% mRNA remaining relative to the aCSF group) in various tissues are shown in FIG. 5 and summarized in Table 14 below. The d113 tau protein results (% remaining relative to the aCSF group) in various tissues are shown in FIG. 6 and summarized in Table 15 below.

Figure 7A:
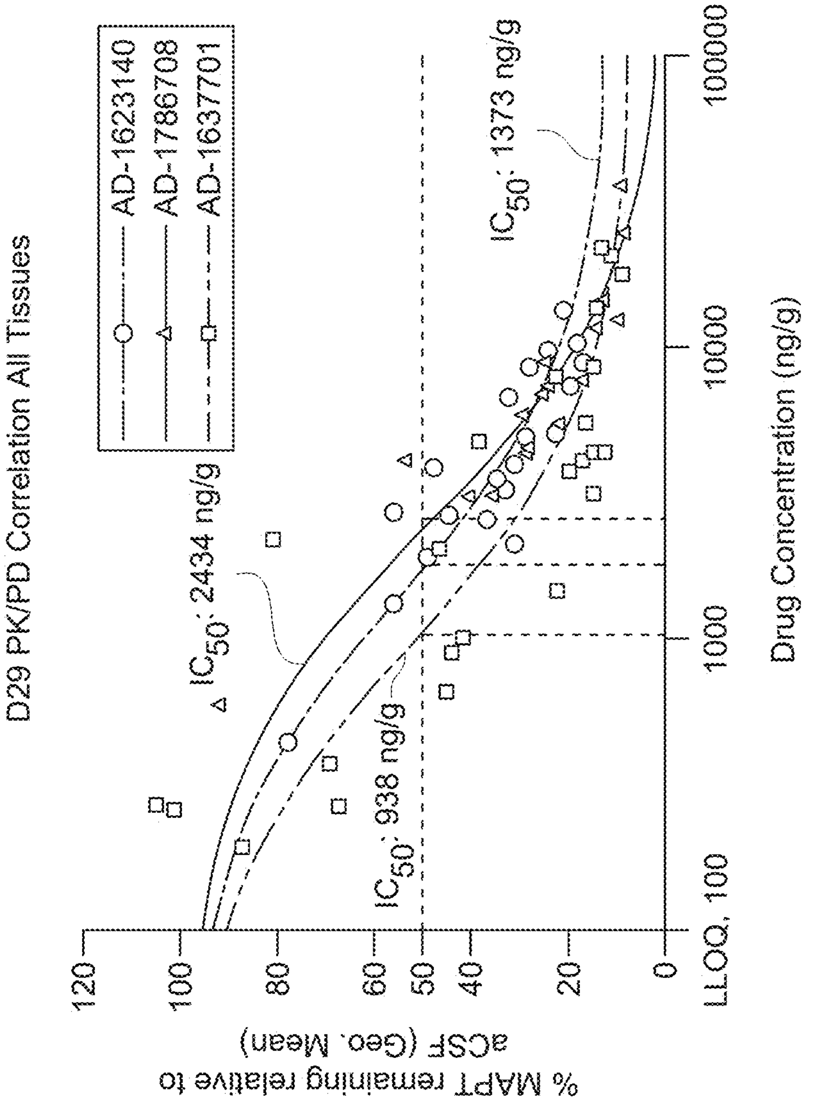
FIGS. 7A-7C depict the pharmacodynamic data from all tissues of the NHP screen correlated against the measured duplex concentration down to the lower limit of quantitation (LLOQ).
Figure 7B:
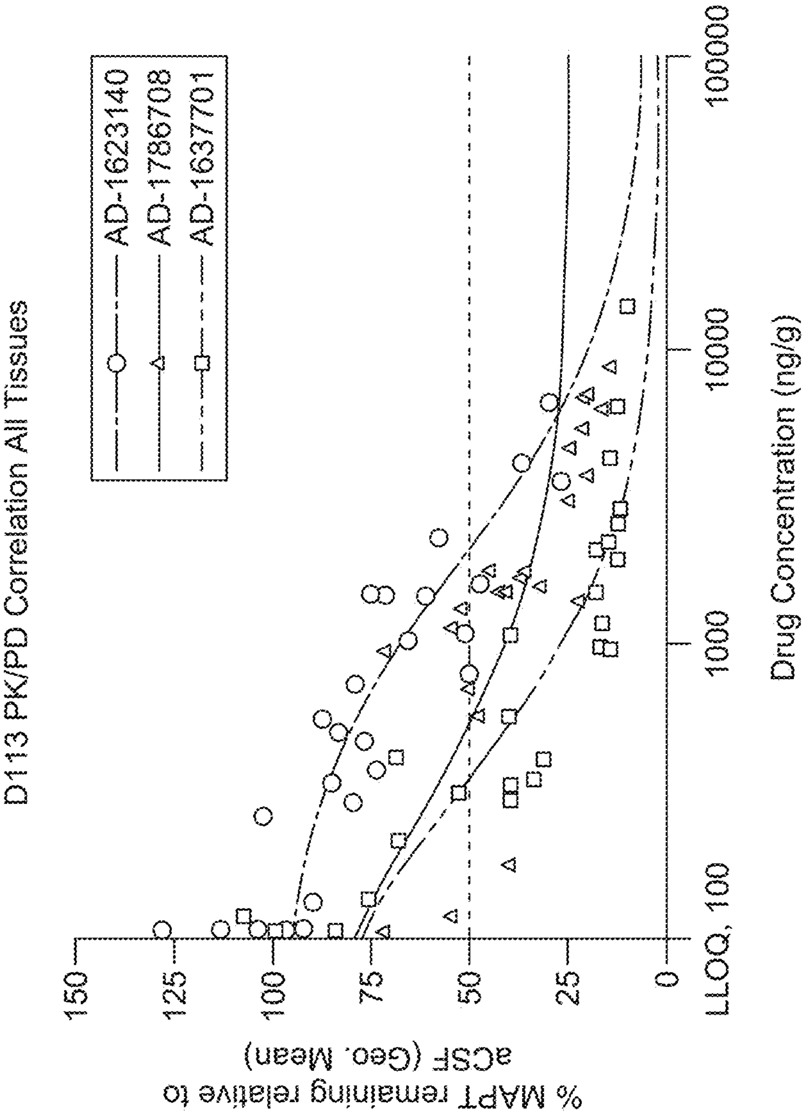
Figure 7C:
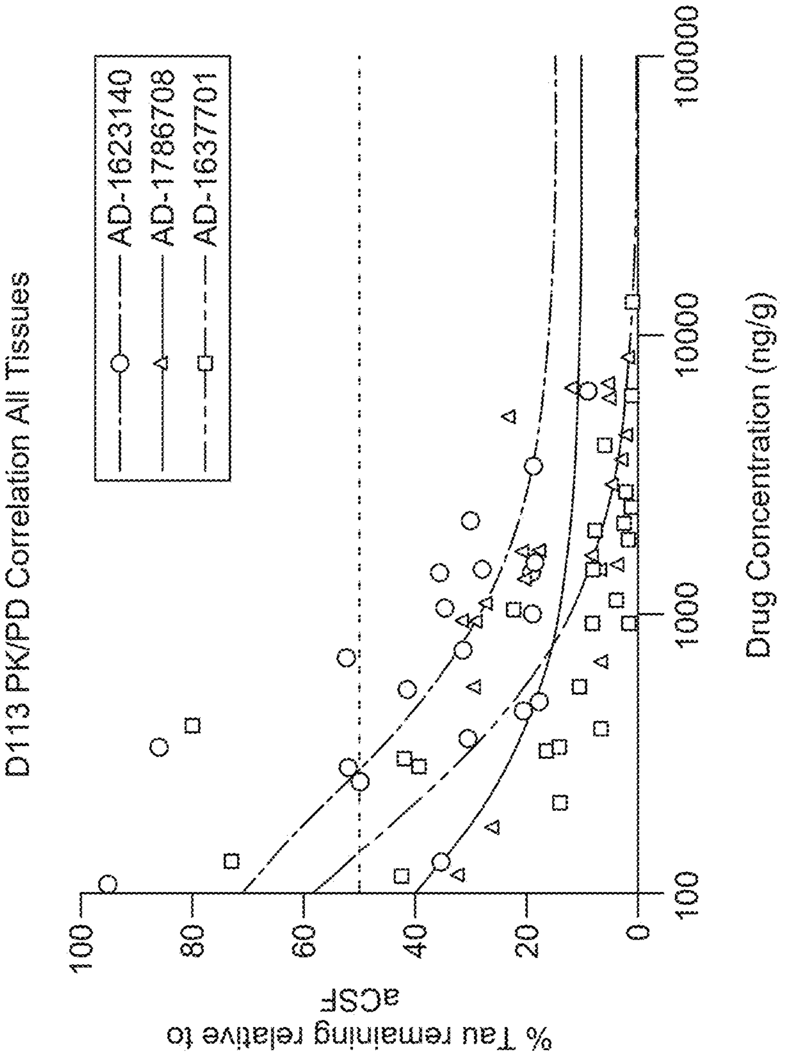

FIG. 7A correlates the d29 pharmacodynamics (PD) to the pharmacokinetics (PK) by mapping the % MAPT mRNA remaining (in all tissues) against the measured duplex concentrations. FIG. 7A identifies the $IC_{50}$ as 1,373 ng/g, 2,434 ng/g, and 938 ng/g for AD-1623140, AD-1786708, and AD-1637701, respectively. FIG. 7B correlates the d113 pharmacodynamics (PD) to the pharmacokinetics (PK) by mapping the % MAPT mRNA remaining (in all tissues) against the measured duplex concentrations. FIG. 7C correlates the d113 pharmacodynamics (PD) to the pharmacokinetics (PK) by mapping the % tau protein remaining (in all tissues) against the measured duplex concentrations.

TABLE 12

| D 29 Transcript Tissue PD (mRNA) | | | | | | | | | | |
|---|---|---|---|---|---|---|---|---|---|---|
| | Prefrontal Cortex | | Putamen | | Hippocampus | | Midbrain | | Thoracic Spinal Cord | |
| Duplex | % mRNA | SD | % mRNA | SD | % mRNA | SD | % mRNA | SD | % mRNA | SD |
| AD-1623140 | 24.22 | 6.52 | 53.09 | 19.58 | 26.10 | 7.76 | 48.03 | 7.94 | 29.26 | 4.97 |
| AD-1786708 | 15.85 | 7.49 | 47.56 | 31.03 | 19.51 | 8.50 | 36.78 | 12.89 | 18.35 | 1.77 |
| AD-1637701 | 14.10 | 2.03 | 57.15 | 13.25 | 16.37 | 5.52 | 37.55 | 10.03 | 15.88 | 2.99 |

TABLE 13

| D 29 Transcript Tissue PD (protein) | | | | | | | | | | |
|---|---|---|---|---|---|---|---|---|---|---|
| | Prefrontal Cortex | | Putamen | | Hippocampus | | Midbrain | | Thoracic Spinal Cord | |
| Duplex | % Tau | SD | % Tau | SD | % Tau | SD | % Tau | SD | % Tau | SD |
| AD-1623140 | 39.86 | 2.00 | 56.28 | 21.07 | 37.33 | 5.66 | 54.29 | 6.74 | 45.90 | 5.09 |
| AD-1786708 | 26.25 | 5.27 | 45.66 | 5.49 | 48.38 | 11.66 | 45.35 | 14.19 | 40.36 | 2.71 |
| AD-1637701 | 26.35 | 3.98 | 38.06 | 8.64 | 44.34 | 6.97 | 45.56 | 6.42 | 34.88 | 2.08 |

TABLE 14

| D 113 Transcript Tissue PD (mRNA) | | | | | | | | | | |
|---|---|---|---|---|---|---|---|---|---|---|
| | Prefrontal Cortex | | Putamen | | Hippocampus | | Midbrain | | Thoracic Spinal Cord | |
| Duplex | % mRNA | SD | % mRNA | SD | % mRNA | SD | % mRNA | SD | % mRNA | SD |
| AD-1623140 | 56.98 | 20.49 | 87.43 | 11.89 | 62.92 | 17.73 | 83.13 | 7.58 | 44.17 | 11.60 |
| AD-1786708 | 27.43 | 14.47 | 55.72 | 19.48 | 32.41 | 12.64 | 59.99 | 12.09 | 28.51 | 9.11 |
| AD-1637701 | 12.80 | 2.67 | 43.30 | 17.25 | 14.28 | 2.11 | 43.20 | 6.56 | 16.30 | 1.94 |

TABLE 15

| D 113 Transcript Tissue PD (protein) | | | | | | | | | | |
|---|---|---|---|---|---|---|---|---|---|---|
| | Prefrontal Cortex | | Putamen | | Hippocampus | | Midbrain | | Thoracic Spinal Cord | |
| Duplex | % Tau | SD | % Tau | SD | % Tau | SD | % Tau | SD | % Tau | SD |
| AD-1623140 | 29.80 | 17.80 | 33.54 | 13.28 | 19.42 | 0.61 | 67.17 | 28.12 | 25.97 | 8.40 |
| AD-1786708 | 9.97 | 11.05 | 14.65 | 11.07 | 4.54 | 2.21 | 28.23 | 4.67 | 19.92 | 5.37 |
| AD-1637701 | 1.83 | 1.51 | 12.81 | 4.16 | 1.89 | 0.61 | 28.45 | 14.80 | 7.40 | 1.00 |

EQUIVALENTS

Those skilled in the art will recognize, or be able to ascertain using no more than routine experimentation, many equivalents to the specific embodiments and methods described herein. Such equivalents are intended to be encompassed by the scope of the following claims.

SEQUENCE LISTING (1269 sequences)

SEQ ID NO: 1 - RNA, 5544 nt, Homo sapiens
  source 1..5544: mol_type = other RNA
ggacggccgagcggcagggcgctcgcgcgcgcccactagtggccggaggagaaggctcccgcggaggccgcgctgcccgccccctcccctggggaggctcgcgttcccgctgctcgcgcctgcgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 2 - RNA, 5544 nt, Homo sapiens
  source 1..5544: mol_type = other RNA
tttaatcagagtaataactttatttccaaattcacttttacagcaacagtcagtgtaaatcatttgttaaaacacacaatacactatatagacattcacagacagaaagctaagctaagatgatttcatgtccctccccccaccctcagaattaccgaagaaatcatgggacttgcaagtgccagaaatagtcctgctcaacatggcaaactcatggggctaagtctattaggaggtgaggctctaggccagtgcccagggtaacccttttcaaagctgaagagaaatcagaagttttatgaagctgcaggtctgtagatgggacacgcaggtgatcacctctgccctcgccccgacctcgtggctttacttggagaacaaagatgaggagggtgaagcgagtgatctcagctccaaaagcacaggctgtgtgtctggagccagtgtgagaggtggcacagaggtgccaacggcttagagggaaggatgccaaggtcttagggaggcatgattgtgggcttaggacccctgaaagagggcagcaggccaaagcaaccagatgtccatattcctacgcctgcacctggctggggagggaatgaactagccagctgcctgggaaagcctgtcagtggaaaagagaaaccccaagggcctctaactccgtggctgctccctccctctagcaaatgtggttgaaatcatgaaaagggttacgaggcagtttaagtgctgcaccccaagatctccctttgcccatgttaactatcttacacattcctcccccctccccccatagcacaacaagcaatagcaaacaggatacagtctcaccactgaagtcaatttaaatggaactattgataaagtgagtcagcagcttgaaggagccggcatacagtatatcctatctagcccacccaaggacactggctctgcaggtgggagaagtgaggggaggggaggagtgcccagccctggggggattgtcctcatttaagatcacaagccagcgtgccttttcaatttatctgccagcactgatcaccctaaaccatgatcttaggctggccccaagagcctgccccacaagggggagatcccagagccttccgtataagaaggcccatggtgctgaagagcagggcacaagaacttcaggaagaggaaccgaggtgcgtgaagaaatgcagccgaaactgttggcagtaatgaggggggcatatctctaaccaccaccaaatctaccccacatttccttctccttctcagatcccttcaacttaggagaattgctgggactcagcgaacggcagggaggctcttggtggagagttctgggcccagagacttcctttcaggtaaagctctagctgcacacgaagctgccagccccaggggaggccctggatttctactgccaagtccctcagggttgcctttaactgtacccaaaccagaagtggcagaattgggcctgaggctgctgagtttctttaggcagcaatgttttgcaaaggcggcttcccttttctcatggcagcagatggagtttgtgcaaggtcagcgggctgaggtgctctggtcaaggctttgggaacagtgtctcctgacttgtcaagtcatccttcctcaggcaggcagcttgggcctctagagcagatccaggacaggcaattcatcccaatccctgctgtggtcgcagggcccttggtgggaggctgcgctgcccctccagagggcgagcttggagaggaacccagtctgaggggtggctgaggctcacggagcttctgggagctgcagatccccccagctggcagtggcttcctttttcttgtgatgcaggagttgtaagcctcctttgggactgccatgagacttcgggctatgaccagagagaaccatcctcgcgccgcaagccagaccagccacaagacctagtctgtgccctgacacagggagccccaaggggaagtagggaaggggacatcatcgcttcagtcctaatcctgtgcttcaggccttcgtcacagctgaacggcctccttagctgctagaagctggtctctgttgggtcccaggtgctgaggaaagcctttcaaaacttgggaggccccagcagggtggcaccacacaggccacacgagtcccagtgtgggggtgagagacacctcgtgagggtgggttagaaacctctttacaagcatttcaagatacatgcgtccttttttttttttttttttcttttcactatcatagtcactctggtgaatccaagcataaacagacaaatccaactacaactcaacagggtgcagatggggagggcagggcaacatctatgtatatgttcagctgctccagcagaacagacagcatggcttccagctgggactgggggaaaagaaccatttccaagggggtgtgttcccctttgtcgggtgtggagggctgatactatgcatgtggagctgagcagcgggctgggctgtctgggaggttggcagctacaagctagggtgcaagtgggggacagcgggactgtgggcctgccctgggtgccttgcccttccatcctggtgccaccactgacaaccaagacacccagcctgctgctgtgggctcagcacaggaaggggccaggccttctcaggggaaagggctctctccatgtcaacaaggcagaaacacctagggtcacagctgagcagtgccctggctcacatctgtgacgggaggaggagacagggaaccgaatcagatcatgagattcgtggtgagggtcccagttggatgagtggaactgagagtgagaggctggggtcccactcttgtgcctggactttgccttcccttaatttcaccctcagtatggagtaggtacctcctgcaaccaaccagggtcattactgagaaggggtggtgaggctgggaattcgggacattgtgacgtgtgatgaggggtataggcagtgattgggctctcacggcagacaacagcacagcggcgcagacggggtgactgcagtggccgtgggaaggacagggggctcgggacctgcctcccagacccccacacactccagagatgccagtggcccaggcttggaaacgggtggacgtctcccaagaggcacaagtccttacaaagagaactggttagccctaaagtcccaggtctgcaaagtggccaaaatcatggcagcagttccaaccttcagaactcaataaaacagggtttctgtggagcagagggaagcccctcaactcaggccccctaccctgcagggagggaggaagaggccagcgctctcaagacatcaaggtcagtcttttctaaggaggtcatccacgaagtgccaccctcctgccagcttgccttctctttttacccgctgtcccttctcccacaggctgccctgcagagggtggcacactgacccacagcaggcccccacccccggccaccaaggacaggcggccgctcagacgctgcaggtggcataggccttggctctcccagcggcaaggagggggatgtctactctccagcacgtggcttcctctcccactcccacttcttgtgcttcctctcccctctgcccagcccctgcctcggcctcccccgtggcctcccgccccaccccaacccccgtcacactcacacaaggttgacatcgtctgcctgtggctccacgaacacaccaagtttcaaatcctttgttgctgccactgcctctgtgacacccccacaacagggccagaggtggttggcacccccagtcccttgaaatcccccagaagcagctttcagagcctctccttctccctcttctacatggagggggaagaaaaaagaatcaaaaggaattgcctgaggaaatgttggatgtggccatgtttttgaatgtttttttttaaatattttattactagcccacccatcaatttggaaagatgaaatttgctcttactcccatcactgattttgaagtcccgagccaaagccgagtgacaaaagcaggttaagtgattaaccaattaaccgaactgcgaggagcagctgggggcagagggcgggggccgggtcattattctttttttttccacactctctcattctctcctctccacaattattgaccgccccaggggcctgatcacaaaccctgcttggccagggaggcagacacctcgtcagctagcgtggcgagctggggcgagtctaccatgtcgatgctgccggtggaggagacattgctgagatgccgtggagacgtgtccccagacaccactggcgacttgtacacgatctccgccccgtggtctgtcttggctttggcgttctcgcggaaggtcagcttgtgggtttcaatctttttatttcctccgccagggacgtgggtgatattgtccagggacccaatcttcgactggactctgtccttgaagtcaagcttctcagattttacttccacctggccacctcctggtttatgatggatgttgcctaatgagccacacttggaggtcaccttgctcaggtcaactggtttgtagactatttgcaccttcccgcctcccggctggtgcttcaggttctcagtggagccgatcttggacttgacattcttcaggtctggcatgggcacgggggctgtctgcaggcggctcttggcggaagacggcgacttgggtggagtacggaccactgccaccttcttgggctcccgggtgggtggggttggaagggacggggtgcgggagcggctgccgggagtgcctggggagccggggctgctgtagccgctgcgatcccctgattttggaggttcaccagagctgggtggtgtctttggagcgggcggggtttttgctggaatcctggtggcgttggcctggcccttctggcctggaggggctgctccccgcggtgtggcgatcttcgttttaccatcagcccccttggcttttttgtcatcgcttccagtcccgtctttgcttttactgaccatgcgagcttgggtcacgtgaccagcagcttcgtcttccaggctgggggtgtctccaatgcctgcttcttcagctttcaggccagcgtccgtgtcaccctcttggtcttggtgcatggtgtagcccccctgatctttcctgtcccccaacccgtacgtcccagcgtgatcttccatcacttcgaactcctggcggggctcagccatcctggttcaaagttcacctgatagtcgacagaggcgaggacgggagaggacagcggaggaggagaaggtggctgtggtggcggcggcagaaggtgggcggtggcagcggcgctgctgttggtgccggagctggtgggtggcggtgactgcgagggcgcgcgccggcgaagagggcgcgttcctgaggccggcgggcggcgcaggcgcgagcagcgggaacgcgagcctccccaggggagggggcgggcagcgcggcctccgcgggagccttctcctccggccactagtgggcgcgcgcgagcgccctgccgctcggccgtcc

SEQ ID NO: 3 - RNA, 5639 nt, Homo sapiens
  source 1..5639: mol_type = other RNA
gcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcaccccgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagcctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcagcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaa

SEQ ID NO: 4 - RNA, 5639 nt, Homo sapiens
  source 1..5639: mol_type = other RNA
tttaatcagagtaataactttatttccaaattcacttttacagcaacagtcagtgtaaatcatttgttaaaacacacaatacactatatagacattcacagacagaaagctaagctaagatgatttcatgtccctccccccaccctcagaattaccgaagaaatcatgggacttgcaagtgccagaaatagtcctgctcaacatggcaaactcatggggctaagtctattaggaggtgaggctctaggccagtgcccagggtaacccttttcaaagctgaagagaaatcagaagttttatgaagctgcaggtctgtagatgggacacgcaggtgatcacctctgccctcgccccgacctcgtggctttacttggagaacaaagatgaggagggtgaagcgagtgatctcagctccaaaagcacaggctgtgtgtctggagccagtgtgagaggtggcacagaggtgccaacggcttagagggaaggatgccaaggtcttagggaggcatgattgtgggcttaggacccctgaaagagggcagcaggccaaagcaaccagatgtccatattcctacgcctgcacctggctggggagggaatgaactagccagctgcctgggaaagcctgtcagtggaaaagagaaaccccaagggcctctaactccgtggctgctccctccctctagcaaatgtggttgaaatcatgaaaagggttacgaggcagtttaagtgctgcaccccaagatctccctttgcccatgttaactatcttacacattcctcccccctccccccatagcacaacaagcaatagcaaacaggatacagtctcaccactgaagtcaatttaaatggaactattgataaagtgagtcagcagcttgaaggagccggcatacagtatatcctatctagcccacccaaggacactggctctgcaggtgggagaagtgaggggaggggaggagtgcccagccctggggggattgtcctcatttaagatcacaagccagcgtgccttttcaatttatctgccagcactgatcaccctaaaccatgatcttaggctggccccaagagcctgccccacaagggggagatcccagagccttccgtataagaaggcccatggtgctgaagagcagggcacaagaacttcaggaagaggaaccgaggtgcgtgaagaaatgcagccgaaactgttggcagtaatgaggggggcatatctctaaccaccaccaaatctaccccacatttccttctccttctcagatcccttcaacttaggagaattgctgggactcagcgaacggcagggaggctcttggtggagagttctgggcccagagacttcctttcaggtaaagctctagctgcacacgaagctgccagccccaggggaggccctggatttctactgccaagtccctcagggttgcctttaactgtacccaaaccagaagtggcagaattgggcctgaggctgctgagtttctttaggcagcaatgttttgcaaaggcggcttcccttttctcatggcagcagatggagtttgtgcaaggtcagcgggctgaggtgctctggtcaaggctttgggaacagtgtctcctgacttgtcaagtcatccttcctcaggcaggcagcttgggcctctagagcagatccaggacaggcaattcatcccaatccctgctgtggtcgcagggcccttggtgggaggctgcgctgcccctccagagggcgagcttggagaggaacccagtctgaggggtggctgaggctcacggagcttctgggagctgcagatccccccagctggcagtggcttcctttttcttgtgatgcaggagttgtaagcctcctttgggactgccatgagacttcgggctatgaccagagagaaccatcctcgcgccgcaagccagaccagccacaagacctagtctgtgccctgacacagggagccccaaggggaagtagggaaggggacatcatcgcttcagtcctaatcctgtgcttcaggccttcgtcacagctgaacggcctccttagctgctagaagctggtctctgttgggtcccaggtgctgaggaaagcctttcaaaacttgggaggccccagcagggtggcaccacacaggccacacgagtcccagtgtgggggtgagagacacctcgtgagggtgggttagaaacctctttacaagcatttcaagatacatgcgtccttttttttttttttttttcttttcactatcatagtcactctggtgaatccaagcataaacagacaaatccaactacaactcaacagggtgcagatggggagggcagggcaacatctatgtatatgttcagctgctccagcagaacagacagcatggcttccagctgggactgggggaaaagaaccatttccaagggggtgtgttcccctttgtcgggtgtggagggctgatactatgcatgtggagctgagcagcgggctgggctgtctgggaggttggcagctacaagctagggtgcaagtgggggacagcgggactgtgggcctgccctgggtgccttgcccttccatcctggtgccaccactgacaaccaagacacccagcctgctgctgtgggctcagcacaggaaggggccaggccttctcaggggaaagggctctctccatgtcaacaaggcagaaacacctagggtcacagctgagcagtgccctggctcacatctgtgacgggaggaggagacagggaaccgaatcagatcatgagattcgtggtgagggtcccagttggatgagtggaactgagagtgagaggctggggtcccactcttgtgcctggactttgccttcccttaatttcaccctcagtatggagtaggtacctcctgcaaccaaccagggtcattactgagaaggggtggtgaggctgggaattcgggacattgtgacgtgtgatgaggggtataggcagtgattgggctctcacggcagacaacagcacagcggcgcagacggggtgactgcagtggccgtgggaaggacagggggctcgggacctgcctcccagacccccacacactccagagatgccagtggcccaggcttggaaacgggtggacgtctcccaagaggcacaagtccttacaaagagaactggttagccctaaagtcccaggtctgcaaagtggccaaaatcatggcagcagttccaaccttcagaactcaataaaacagggtttctgtggagcagagggaagcccctcaactcaggccccctaccctgcagggagggaggaagaggccagcgctctcaagacatcaaggtcagtcttttctaaggaggtcatccacgaagtgccaccctcctgccagcttgccttctctttttacccgctgtcccttctcccacaggctgccctgcagagggtggcacactgacccacagcaggcccccacccccggccaccaaggacaggcggccgctcagacgctgcaggtggcataggccttggctctcccagcggcaaggagggggatgtctactctccagcacgtggcttcctctcccactcccacttcttgtgcttcctctcccctctgcccagcccctgcctcggcctcccccgtggcctcccgccccaccccaacccccgtcacactcacacaaggttgacatcgtctgcctgtggctccacgaacacaccaagtttcaaatcctttgttgctgccactgcctctgtgacacccccacaacagggccagaggtggttggcacccccagtcccttgaaatcccccagaagcagctttcagagcctctccttctccctcttctacatggagggggaagaaaaaagaatcaaaaggaattgcctgaggaaatgttggatgtggccatgtttttgaatgtttttttttaaatattttattactagcccacccatcaatttggaaagatgaaatttgctcttactcccatcactgattttgaagtcccgagccaaagccgagtgacaaaagcaggttaagtgattaaccaattaaccgaactgcgaggagcagctgggggcagagggcgggggccgggtcattattctttttttttccacactctctcattctctcctctccacaattattgaccgccccaggggcctgatcacaaaccctgcttggccagggaggcagacacctcgtcagctagcgtggcgagctggggcgagtctaccatgtcgatgctgccggtggaggagacattgctgagatgccgtggagacgtgtccccagacaccactggcgacttgtacacgatctccgccccgtggtctgtcttggctttggcgttctcgcggaaggtcagcttgtgggtttcaatctttttatttcctccgccagggacgtgggtgatattgtccagggacccaatcttcgactggactctgtccttgaagtcaagcttctcagattttacttccacctggccacctcctggtttatgatggatgttgcctaatgagccacacttggaggtcaccttgctcaggtcaactggtttgtagactatttgcacactgccgcctcccgggacgtgtttgatattatcctttgagccacacttggactggacgttgctaagatccagcttcttattaattatctgcaccttcccgcctcccggctggtgcttcaggttctcagtggagccgatcttggacttgacattcttcaggtctggcatgggcacgggggctgtctgcaggcggctcttggcggaagacggcgacttgggtggagtacggaccactgccaccttcttgggctcccgggtgggtggggttggaagggacggggtgcgggagcggctgccgggagtgcctggggagccggggctgctgtagccgctgcgatcccctgattttggaggttcaccagagctgggtggtgtctttggagcgggcggggtttttgctggaatcctggtggcgttggcctggcccttctggcctggaggggctgctccccgcggtgtggcgatcttcgttttaccatcagcccccttggcttttttgtcatcgcttccagtcccgtctttgcttttactgaccatgcgagcttgggtcacgtgaccagcagcttcgtcttccaggctgggggtgtctccaatgcctgcttcttcagctgtggttccttctgggatctccgtgtggggctgcgcggcagcctgcttgccgggagctccctcatccactaagggtgctgtcacatcttccgctgttggagtgctcttagcatcagaggtttcagagcccggttcctcagatccgtcctcagtgggggtctgcaggggagattctttcaggccagcgtccgtgtcaccctcttggtcttggtgcatggtgtagcccccctgatctttcctgtcccccaacccgtacgtcccagcgtgatcttccatcacttcgaactcctggcggggctcagccatcctggttcaaagttcacctgatagtcgacagaggcgaggacgggagaggacagcggaggaggagaaggtggctgtggtggcggcggcagaaggtgggcggtggcagcggcgctgctgttggtgccggagctggtgggtggcggtgactgc

SEQ ID NO: 5 - RNA, 5396 nt, Mus musculus
  source 1..5396: mol_type = other RNA
ccgccggcctccagaacgcgctttctcggccgcgcgcgctctcagtctccgccacccaccagctccagcaccagcagcagcgccgccgccaccgcccaccttctgccgccgccgccacaaccaccttctcctccgctgtcctcttctgtcctcgccttctgtcgattatcaggctttgaaccagtatggctgaccctcgccaggagtttgacacaatggaagaccatgctggagattacactctgctccaagaccaagaaggagacatggaccatggcttaaaagagtctcccccacagccccccgccgatgatggagcggaggaaccagggtcggagacctccgatgctaagagcactccaactgctgaagacgtgactgcgcccctagtggatgagagagctcccgacaagcaggccgctgcccagccccacacggagatcccagaaggaattacagccgaagaagcaggcatcggagacaccccgaaccaggaggaccaagccgctgggcatgtgactcaagctcgtgtggccagcaaagacaggacaggaaatgacgagaagaaagccaagggcgctgatggcaaaaccggggcgaagatcgccacacctcggggagcagcctctccggcccagaagggcacgtccaacgccaccaggatcccggccaagaccacgcccagccctaagactcctccagggtcaggtgaaccaccaaaatccggagaacgaagcggctacagcagccccggctctcccggaacgcctggcagtcgctcgcgcaccccatccctaccaacaccgcccacccgggagcccaagaaggtggcagtggtccgcactccccctaagtcaccatcagctagtaagagccgcctgcagactgcccctgtgcccatgccagacctaaagaatgtcaggtcgaagattggctctactgagaacctgaagcaccagccaggaggtggcaaggtgcagataattaataagaagctggatcttagcaacgtccagtccaagtgtggctcgaaggataatatcaaacacgtcccgggtggaggcagtgtgcaaatagtctacaagccggtggacctgagcaaagtgacctccaagtgtggctcgttagggaacatccatcacaagccaggaggtggccaggtggaagtaaaatcagagaagctggacttcaaggacagagtccagtcgaagattggctccttggataatatcacccacgtccctggaggagggaataagaagattgaaacccacaagctgaccttcagggagaatgccaaagccaagacagaccatggagcagaaattgtgtataagtcacccgtggtgtctggggacacatctccacggcacctcagcaatgtgtcttccacgggcagcatcgacatggtggactcaccacagcttgccacactagccgatgaagtgtctgcttccttggccaagcagggtttgtgatcaggctcccagggcagtcaataatcatggagagaagagagagtgagagtgtggaaaaaaaaaaaaaaaaagaatgatctggccccttgccctctgccctccccgctgctcctcatagacaggctgacctgcttgtcacctaacctgcttttgtggctcggatttggctcgggacttcaaaatcagtgatgggaaaagtacatttcatctttccaaattgatttgtgggctaaaaataaaacatatttaagggaaaaaaaaacatgtaaaaacatggccaaaaaatttccttgggcaattgctaattgatttcccccccctgaccccgccctccctctctgagtattagagggtgaagaaggctctggaggctgcttctggggagtggctgagggactagggcagctaattgcccatagccccatcctaggggcttcagggacagtggcagcaatgagagatttgagacttggtgtgttcgtggggccgtaggcaggtgctgttaacttgtgtgggtgtgagtggggactgaaacagcgacagcgaaggctgagagatggatgggtggactgagttagaggacagaggtgaggaaggcaggttgggagaggggacactggctccttgccaagtagcttggggaggacagggtgctgcagctgcctgcagcagtcctagctagctcagatgcctgcttgataaagcactgtgggggtaacgtgggtgtgtgtgccccttctgcagggcagcctgtgggagaaggggtattgggcagaaggaaggtaagccagcaggtggtaccttgtagattggttctcttgaaggctgctcttgacatcccagggcactggcttcttcctccctccccgcaaggtgggaggtcctgagcgaggtgtttcccttcgctcccacaggaaaagctgctttactgagttctcaagtttggaactacagccatgatttggccaccattacagacctgggactttagggctaaccagatctttgtaaggacttgtgcctcttgggggacctctgcctgttctcatgcttggccctctggcacttctgtagtgggagggatggggggtggtattctgggatgtgggtcccaggcctcccatccctcacacagccactgtatcccctctctctgtcctatcatgcccacgtctgccacgagagctagtcactgccgtccgtacatcacgtctcactgtcctgagtgccatgcctctcccagcccccatccctggcccctgggtagatatgggcaatatctgctctacactaggggttggagtccagggaaggcaaagatttgggcctcagtctctagtcctacgttccacgaatccaaccagtgtgcctcccacaaggaaccttacgaccttgtttggttcactccattacttcctatcctggatgggaactggtgtgtgcctgcctggggatgaccttggacctctgccttttcttttatctaagtggatgcctcctaggcctgactccttgtgttgagctggaggcagccaagtcaggtgccaatgtcttggcatcagtaagaacagtcaagagtcccagggcagggccacacttctcccatctttcgcttccaccccagcttgtgatcgctagcctcccagagctcagctgccattaagtccccatgcacgtaatcagtctccacaccccagtttggggaacatacccccttgattgaagtgtttttttcctccggtcccatggaaaccatgctgcctgccctgctggagcagacggccacctccatagatgcagccctttctttcccgtcttcgccctgttacgttgtagttggatttgtctgtttgtctgggttcaccagagtgactatgatagtgaaaagaaaagaaagaaaaagaaaaaaaaaaaaaaaaagaaaaagaaaaaggaaaaaaaaaaggacgcatgtatcttgaaatatttgtcaaaaggttctagcccaccacgtgatggagagtctggatatctccttcctgacgtggctccaggccagtgcagtgctaacctgctgggacatcccatgttttgaagggtttcttctgcatctgggacctcacagacactggattgtgacattggaggtctgtgacattggaggtcaatggcattggccaaggcctgaagcacaggaccagctagaggcagcaggctccgagtgccagggagagcttgtggctggcctgttttgtatgaagatggtcctttctgatcacgacttcaaatcccacagtagccctgaaagacatctaagaactcctgcatcacaagagaaaaggacaccagtaccagcagggagagctgtgaccctagaaattccatgacgacccagtagatatccttgggccctctccaagcctgggccttttcaccatagagtttgggatggactgtcccactgatgaaggggacatcttaggagactcccttggtttccaagctgtcagccccctgaacttgcacgacctcctacagcttcagggactaggcctttgaagattaggaacctcaggcccacatcagccacttctgatgtacagttaaggacaatgtggagactaggaggaagcagccagcctttcccattaaagaactcttgagtgcccagggctacctattgtgagcttccccactgataagactttagctgtccatagaagtgagtccgagggaggaaaagtgtggtttcttcatcatggttacctgtcgtggttctctctcttacacccatttacccatcccgcagttcctgtccttgaatggggggtggggtgctctgcctatctcttgtggggtgatcagcccaaaaatcatgatttggagtgatctgatcagtgctgataggcagtttacaaagggattctggcttgtgacttcagtgaggacaatcccccagggccctttctttccatgcctctccaactcagagccaatgtctttgggtgggctagatagatagggcatacaattggcctggttcctccaagctcttaattcactttatcaatagttccatttaaattgacttcaatgataagagtgtatcccatttgagattgcttgcgttgtgggggagggggaggaggaacacattaagataattcacatgggcaaagggaggtcttggagtgtagccgttaagccatcttgtaaccccattcatgattttgaccacctgctagagagaagaggtgccaagagactagaacttggaggcttggctgtcccactaataggctttcgcaaggcagaggtagccagctaggtccctgccttcccagccaggtacagctctcaggtttgtggaggtaatctgtgaacttctcttcctgctgccttcttgtgatgtccagagcccacagtcaaatacctcctaagaaccctggcttccttccctctaatccactggcacatgactatcacctctggattgacctcagatccatagcctacacactgctagcagtggccaagatcacttcctttatctccatctgttctgttctccaggaaagtaagtggggatgagggtggaggtggtaatcaactgtagatctgtggctttatgagccttcagacttctctctggcttcttctggaagggttactattggcagtattgcaatctcaccctcctgatgaactgtagcctgtgccgttactgtgctgggcatgatctccagtgcttgcaagtcccatgatttctttggtgattttgagggtggggggagggacacaaatcagcttagcttagcttcctgtctgtgaatgtccatatagtgtattgtgttttaacaaatgatctacactgactgttgctgtaaaagtgaatttggaaataaagttattactctgaataaaaaaaaaaaaaaaaaa

SEQ ID NO: 6 - RNA, 5396 nt, Mus musculus
  source 1..5396: mol_type = other RNA
ttttttttttttttttttattcagagtaataactttatttccaaattcacttttacagcaacagtcagtgtagatcatttgttaaaacacaatacactatatggacattcacagacaggaagctaagctaagctgatttgtgtccctccccccaccctcaaaatcaccaaagaaatcatgggacttgcaagcactggagatcatgcccagcacagtaacggcacaggctacagttcatcaggagggtgagattgcaatactgccaatagtaacccttccagaagaagccagagagaagtctgaaggctcataaagccacagatctacagttgattaccacctccaccctcatccccacttactttcctggagaacagaacagatggagataaaggaagtgatcttggccactgctagcagtgtgtaggctatggatctgaggtcaatccagaggtgatagtcatgtgccagtggattagagggaaggaagccagggttcttaggaggtatttgactgtgggctctggacatcacaagaaggcagcaggaagagaagttcacagattacctccacaaacctgagagctgtacctggctgggaaggcagggacctagctggctacctctgccttgcgaaagcctattagtgggacagccaagcctccaagttctagtctcttggcacctcttctctctagcaggtggtcaaaatcatgaatggggttacaagatggcttaacggctacactccaagacctccctttgcccatgtgaattatcttaatgtgttcctcctccccctcccccacaacgcaagcaatctcaaatgggatacactcttatcattgaagtcaatttaaatggaactattgataaagtgaattaagagcttggaggaaccaggccaattgtatgccctatctatctagcccacccaaagacattggctctgagttggagaggcatggaaagaaagggccctgggggattgtcctcactgaagtcacaagccagaatccctttgtaaactgcctatcagcactgatcagatcactccaaatcatgatttttgggctgatcaccccacaagagataggcagagcaccccaccccccattcaaggacaggaactgcgggatgggtaaatgggtgtaagagagagaaccacgacaggtaaccatgatgaagaaaccacacttttcctccctcggactcacttctatggacagctaaagtcttatcagtggggaagctcacaataggtagccctgggcactcaagagttctttaatgggaaaggctggctgcttcctcctagtctccacattgtccttaactgtacatcagaagtggctgatgtgggcctgaggttcctaatcttcaaaggcctagtccctgaagctgtaggaggtcgtgcaagttcagggggctgacagcttggaaaccaagggagtctcctaagatgtccccttcatcagtgggacagtccatcccaaactctatggtgaaaaggcccaggcttggagagggcccaaggatatctactgggtcgtcatggaatttctagggtcacagctctccctgctggtactggtgtccttttctcttgtgatgcaggagttcttagatgtctttcagggctactgtgggatttgaagtcgtgatcagaaaggaccatcttcatacaaaacaggccagccacaagctctccctggcactcggagcctgctgcctctagctggtcctgtgcttcaggccttggccaatgccattgacctccaatgtcacagacctccaatgtcacaatccagtgtctgtgaggtcccagatgcagaagaaacccttcaaaacatgggatgtcccagcaggttagcactgcactggcctggagccacgtcaggaaggagatatccagactctccatcacgtggtgggctagaaccttttgacaaatatttcaagatacatgcgtccttttttttttcctttttctttttctttttttttttttttttctttttctttcttttcttttcactatcatagtcactctggtgaacccagacaaacagacaaatccaactacaacgtaacagggcgaagacgggaaagaaagggctgcatctatggaggtggccgtctgctccagcagggcaggcagcatggtttccatgggaccggaggaaaaaaacacttcaatcaagggggtatgttccccaaactggggtgtggagactgattacgtgcatggggacttaatggcagctgagctctgggaggctagcgatcacaagctggggtggaagcgaaagatgggagaagtgtggccctgccctgggactcttgactgttcttactgatgccaagacattggcacctgacttggctgcctccagctcaacacaaggagtcaggcctaggaggcatccacttagataaaagaaaaggcagaggtccaaggtcatccccaggcaggcacacaccagttcccatccaggataggaagtaatggagtgaaccaaacaaggtcgtaaggttccttgtgggaggcacactggttggattcgtggaacgtaggactagagactgaggcccaaatctttgccttccctggactccaacccctagtgtagagcagatattgcccatatctacccaggggccagggatgggggctgggagaggcatggcactcaggacagtgagacgtgatgtacggacggcagtgactagctctcgtggcagacgtgggcatgataggacagagagaggggatacagtggctgtgtgagggatgggaggcctgggacccacatcccagaataccaccccccatccctcccactacagaagtgccagagggccaagcatgagaacaggcagaggtcccccaagaggcacaagtccttacaaagatctggttagccctaaagtcccaggtctgtaatggtggccaaatcatggctgtagttccaaacttgagaactcagtaaagcagcttttcctgtgggagcgaagggaaacacctcgctcaggacctcccaccttgcggggagggaggaagaagccagtgccctgggatgtcaagagcagccttcaagagaaccaatctacaaggtaccacctgctggcttaccttccttctgcccaataccccttctcccacaggctgccctgcagaaggggcacacacacccacgttacccccacagtgctttatcaagcaggcatctgagctagctaggactgctgcaggcagctgcagcaccctgtcctccccaagctacttggcaaggagccagtgtcccctctcccaacctgccttcctcacctctgtcctctaactcagtccacccatccatctctcagccttcgctgtcgctgtttcagtccccactcacacccacacaagttaacagcacctgcctacggccccacgaacacaccaagtctcaaatctctcattgctgccactgtccctgaagcccctaggatggggctatgggcaattagctgccctagtccctcagccactccccagaagcagcctccagagccttcttcaccctctaatactcagagagggagggcggggtcaggggggggaaatcaattagcaattgcccaaggaaattttttggccatgtttttacatgtttttttttcccttaaatatgttttatttttagcccacaaatcaatttggaaagatgaaatgtacttttcccatcactgattttgaagtcccgagccaaatccgagccacaaaagcaggttaggtgacaagcaggtcagcctgtctatgaggagcagcggggagggcagagggcaaggggccagatcattctttttttttttttttttccacactctcactctctcttctctccatgattattgactgccctgggagcctgatcacaaaccctgcttggccaaggaagcagacacttcatcggctagtgtggcaagctgtggtgagtccaccatgtcgatgctgcccgtggaagacacattgctgaggtgccgtggagatgtgtccccagacaccacgggtgacttatacacaatttctgctccatggtctgtcttggctttggcattctccctgaaggtcagcttgtgggtttcaatcttcttattccctcctccagggacgtgggtgatattatccaaggagccaatcttcgactggactctgtccttgaagtccagcttctctgattttacttccacctggccacctcctggcttgtgatggatgttccctaacgagccacacttggaggtcactttgctcaggtccaccggcttgtagactatttgcacactgcctccacccgggacgtgtttgatattatccttcgagccacacttggactggacgttgctaagatccagcttcttattaattatctgcaccttgccacctcctggctggtgcttcaggttctcagtagagccaatcttcgacctgacattctttaggtctggcatgggcacaggggcagtctgcaggcggctcttactagctgatggtgacttagggggagtgcggaccactgccaccttcttgggctcccgggtgggcggtgttggtagggatggggtgcgcgagcgactgccaggcgttccgggagagccggggctgctgtagccgcttcgttctccggattttggtggttcacctgaccctggaggagtcttagggctgggcgtggtcttggccgggatcctggtggcgttggacgtgcccttctgggccggagaggctgctccccgaggtgtggcgatcttcgccccggttttgccatcagcgcccttggctttcttctcgtcatttcctgtcctgtctttgctggccacacgagcttgagtcacatgcccagcggcttggtcctcctggttcggggtgtctccgatgcctgcttcttcggctgtaattccttctgggatctccgtgtggggctgggcagcggcctgcttgtcgggagctctctcatccactaggggcgcagtcacgtcttcagcagttggagtgctcttagcatcggaggtctccgaccctggttcctccgctccatcatcggcggggggctgtgggggagactcttttaagccatggtccatgtctccttcttggtcttggagcagagtgtaatctccagcatggtcttccattgtgtcaaactcctggcgagggtcagccatactggttcaaagcctgataatcgacagaaggcgaggacagaagaggacagcggaggagaaggtggttgtggcggcggcggcagaaggtgggcggtggcggcggcgctgctgctggtgctggagctggtgggtggcggagactgagagcgcgcgcggccgagaaagcgcgttctggaggccggcgg

SEQ ID NO: 7 - RNA, 5790 nt, Macaca fascicularis
  source 1..5790: mol_type = other RNA
gccgagcggcagggcgctcgcgcgcgcccactggtggccggaggagaaggctcccgcggaggccgggctgcccgccccctcccctggggaggctcgcgctcccgctgctcgcgcctgcgccgcctgccggcctcgggaacgcgccctcttccccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggcgagccttgaaccaggatggctgagccccgccaggagttcgatgtgatggaagatcacgctgggacgtacgggttgggggacaggaaagatcaagagggctacaccatgctccaagaccaagagggtgacacggacgctggcctgaaagaatctcccctgcagacccccgctgaggatggatctgaggaactgggctctgaaacctctgatgctaagagcactccaacggcggaagatgtgacagcgcccttagtggatgagagagctcccggcgagcaggctgccgcccagccccacatggagatcccagaaggaaccacagctgaggaagcaggcatcggagacacccccagcctggaagacgaagctgctggtcacgtgacccaagctcgcatggtcagtaaaagcaaagacgggactggaagcgatgacaaaaaagccaagggggctgatgggaaaacgaagatcgccacaccccggggagcggcccctccaggccagaagggccaagccaacgccaccaggattccagcaaaaaccccgcccgccccaaagacaccacccagctctggtgaacctccaaaatcaggggatcgcagtggctacagcagccccggctccccgggcactcccggcagccgctcccgcaccccgtcccttccaacccctccagcccgggagcccaagaaggtggcggtggtccgtactccacctaagtcgccgtcttccgccaagagccgcctgcagacagcccccgtgcccatgccagacctgaagaacgtcaagtccaagatcggctccaccgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagctggacttcaaggacagagtgcagtcgaagatcgggtccctggacaatatcacccatgtccctggcggaggaaataaaaagattgaaacccacaagctgaccttccgcgagaacgccaaagccaagacagaccacggggcggaaatcgtgtacaagtcgccggtggtgtctggggacacgtctccacggcacctcagcaatgtctcctccaccggcagcatcgacatggtagactcgccccagctcgccacgctagccgacgaggtgtctgcctccctggccaagcagggtttgtgatcaggcccccggggcggtcaataatcgtggagagaagagagagtgagagtgtggaaaaaaaaagaataatgacccggccccgccctctgcccccagctgctcctcgcagttcggttaatcggttcatcacttaaccggcttttatcgctcggctttggctcgggacttcaaaatcagtgatgggaataagagcaaattgcatctttccaaattgatcggtgggctaataataaaatattttttaaaaaacattcaaaaacatggccacacccaacatttcctcgggcaattccttttgattctttttttttccccctccatgtagaagagggagaaggagaggctgtgaaagctgcttcggggggatttcaagagactgggggtgcccaccgcctctggccctgtcgtgggggtgtcacagaggcagcggcagcaacaaaggatttgaaacttggtgtgttcgtggagccacaggcagacgatgtcaaccttgtgtgagtgtgacgggtgggggtggggcgggaggccatgggggaggccaaggcaggggctgggcagaggggagaggaaggacgagaagggggagtgggagaggaagccacatgctggagaggagatgccctcctccgcgccactgggagggccaaggcctccgccacctgcagtgtctcagactgagcggctgcctgtccttggtggccagggtctgctgcgagttgatgtgccaccctctgcagggcagcctgtgggagaaggggcggcgggtaagaagagaaggcaagctggcgggagggtggcaccccgtggatgacctccttggaaaagactgaccttgatgtcggagggcgctggcctcttcctccctccctgcagggtagggggcctgagccgaggggcttccctctgctccacagaaaccctgttttattgagttctgaaggttggaactgcagccatgattttggccactttgcagacctgggactttagggctaaccagttctctttgtaaggacttgtgcctcttgggagacgtccacccgtttccaagcctgggccaccggcatctctggagtgtgcaggggtctgggaggcgggtcccgagccccctgtccttcccacggccactgcagtcacccctgtctgccccactgtgctgtcgtctgccatgagaacccagtcactgcctatacccctcatcacgtcacaatgtccaaattcccagcctcaccaccccccttctcagtaaggaccctggttggctgtgggaggcacctactccatactgagggtgaaattaagggaaggtaaagtccaggcacaagagtgggaccccagcctctcactctcagttccactcatccaactgggtccctcaccacgaatctcacgacctgattcggttccctgcctcctcctcccatcacagatgtgagccagggcactgctcagctgtgaccctcggtgtttctgccttgttgacatagagagagccctttccccccgagaaggcctggccccttcctgtgctgagcccgcagcaggaggctgggtgtcctggttgtcggtgacggcaccaggatgggcgggcaaggcacccagggcaggcccacagtcccgctgtcccccacttgcaccccagcttgtggctgccagcctcccagacagcccagcccgctgctcagctccacatgcatagaatcagccctccacatcccaaaaaggggaacacacccccttcgaaatggttttctccccggtcccagctggaagccatgctgtctgttctgctggagcagctgaacatatacatagatgttgccctgccctccccatctgcaccctgttgcgttgtagttggatttgtctgtttatgcttggattcaccagagtgactatgatagtgaaaagaaaaaaaaaaaaaaaaaaaggacgcatgtatcttgaaatgcttgtaaagaggtttctaacccaccctcacaaggtgtctctcacccccacgctgggacgcgtgtggcctgtgtggcgccgccctgctggggcctcccaaggtttgaaaggctttcctcagcatccgggacccaacagagaccagattctagcatctaaggaggccgttcagctgtgaagaaggcctgaagcacaggattaggactgaagcgatgacatctccttccctacttccccttggggctctctgtgtcagggcagagagtaggtcttgtggctggtctggcttgcggcacgaggatggttctctctggtcacagcccgaagtcccacagcagtcctaaaggaggcttacaactcctgcatcacaagaagaaggaagccagtgccagctggggggatctgcagctcccagaagctccatgagcctcagccaccccgcagactgggttcctcgccaagctcgccctctggaggggcagccagcctcccaccaagggccctgcgaccacagcagggattgggatgaatggcctatcctggatctgctccagaggcccgagccacctgcctgaggaaggataagtcaggagacaccgttcccaaagccttgaccagagcacctcagcccactgaccttgcacaaactccatctgctgccatgagaaaagggaagccgcctttgcaaaaaattgctgcctaaagaaactcagcagcctcaggctcaattctgccgcttctggtttgggtacagttaaaggcaaccctgagggacttggcagtagaaatccagggcatcccctagggctggcaacttcgtgtgcagctagagctttccctgcaagaagtttctgggcccagaactctccaccaggaagctccctgctgttcgctaagtcccagcaattctctaagtgaagggatctgagaatgaggaggaaatgtggggtagagatttggtggtggttagagacatgcccccctcattactgccaacagtttcggctgcatttttcacgtacctcggttcctcttcctgaagttcttgtgccctgctcttcagcaccgtgggccttatccggtaggctctgggatctcccccttgtggggcaggctcttggggccagcctaagatcatggtttagggtgatcagtgctggcagataaattgcaaaggcacgctggcttgtgacctcaaatgacaatccccccagggctgggcactcctcccctcccctcacttctcccacctgcagagccagtgtccgtgggtgggctagataggatatactgtatgccggctccttcaagctgttgactcactttatcaatagttccatttaaattgacttcaatggtgagactgtatcctgtttgctattgcttattgtgctatggggggaggggggaggaatgtgtaacatagttaacatgggtaaagggagatcttggggtgcagcacttcaattgcctcgtaacccttttcatcatttcaaccacatttgctaaagggagggagcagccacgcggttagaggcccttggggtttctcttttccactgacagcctttcccaggcagctggccagttccccattccctccccagccaggtgcaggcgtagcaatatggacatctggttgctttggcctgctgccctctttcaggggtcctaagcccacaatcatgcctccctaagaccctggcatccttccttttaagccgttggcacctctgtgccacctctcacactggctccagacacagcctgtgcttctggcagctgagatcactcacttccccctcctcatctttgttggagctccaagtcaagccacgaggtcagggcgagggcagaggtggtcaccagcgtgtcccatctacagacctgtggcttcgtaagacttctgatttctcttcagctttgaaaagggttaccctgggcactggcctagagtctcacctcctaatagacttacccccatgagtttgccatgttgagcaggacaatttctggcacttgcaagtcccatgatttcttcggtaattgtgagggtggggggagggacatgaaatcatcttagcttagcttcctgtctgtgaatgtctatatagtgtattgtgtgttttaacaaatgatttacactgactgttgccgtaaaagtgaatttggaaataaagttattactctgattaaa

SEQ ID NO: 8 - RNA, 5790 nt, Macaca fascicularis
  source 1..5790: mol_type = other RNA
tttaatcagagtaataactttatttccaaattcacttttacggcaacagtcagtgtaaatcatttgttaaaacacacaatacactatatagacattcacagacaggaagctaagctaagatgatttcatgtccctccccccaccctcacaattaccgaagaaatcatgggacttgcaagtgccagaaattgtcctgctcaacatggcaaactcatgggggtaagtctattaggaggtgagactctaggccagtgcccagggtaacccttttcaaagctgaagagaaatcagaagtcttacgaagccacaggtctgtagatgggacacgctggtgaccacctctgccctcgccctgacctcgtggcttgacttggagctccaacaaagatgaggagggggaagtgagtgatctcagctgccagaagcacaggctgtgtctggagccagtgtgagaggtggcacagaggtgccaacggcttaaaaggaaggatgccagggtcttagggaggcatgattgtgggcttaggacccctgaaagagggcagcaggccaaagcaaccagatgtccatattgctacgcctgcacctggctggggagggaatggggaactggccagctgcctgggaaaggctgtcagtggaaaagagaaaccccaagggcctctaaccgcgtggctgctccctccctttagcaaatgtggttgaaatgatgaaaagggttacgaggcaattgaagtgctgcaccccaagatctccctttacccatgttaactatgttacacattcctcccccctccccccatagcacaataagcaatagcaaacaggatacagtctcaccattgaagtcaatttaaatggaactattgataaagtgagtcaacagcttgaaggagccggcatacagtatatcctatctagcccacccacggacactggctctgcaggtgggagaagtgaggggaggggaggagtgcccagccctggggggattgtcatttgaggtcacaagccagcgtgcctttgcaatttatctgccagcactgatcaccctaaaccatgatcttaggctggccccaagagcctgccccacaagggggagatcccagagcctaccggataaggcccacggtgctgaagagcagggcacaagaacttcaggaagaggaaccgaggtacgtgaaaaatgcagccgaaactgttggcagtaatgaggggggcatgtctctaaccaccaccaaatctctaccccacatttcctcctcattctcagatcccttcacttagagaattgctgggacttagcgaacagcagggagcttcctggtggagagttctgggcccagaaacttcttgcagggaaagctctagctgcacacgaagttgccagccctaggggatgccctggatttctactgccaagtccctcagggttgcctttaactgtacccaaaccagaagcggcagaattgagcctgaggctgctgagtttctttaggcagcaattttttgcaaaggcggcttcccttttctcatggcagcagatggagtttgtgcaaggtcagtgggctgaggtgctctggtcaaggctttgggaacggtgtctcctgacttatccttcctcaggcaggtggctcgggcctctggagcagatccaggataggccattcatcccaatccctgctgtggtcgcagggcccttggtgggaggctggctgcccctccagagggcgagcttggcgaggaacccagtctgcggggtggctgaggctcatggagcttctgggagctgcagatccccccagctggcactggcttccttcttcttgtgatgcaggagttgtaagcctcctttaggactgctgtgggacttcgggctgtgaccagagagaaccatcctcgtgccgcaagccagaccagccacaagacctactctctgccctgacacagagagccccaaggggaagtagggaaggagatgtcatcgcttcagtcctaatcctgtgcttcaggccttcttcacagctgaacggcctccttagatgctagaatctggtctctgttgggtcccggatgctgaggaaagcctttcaaaccttgggaggccccagcagggcggcgccacacaggccacacgcgtcccagcgtgggggtgagagacaccttgtgagggtgggttagaaacctctttacaagcatttcaagatacatgcgtcctttttttttttttttttttcttttcactatcatagtcactctggtgaatccaagcataaacagacaaatccaactacaacgcaacagggtgcagatggggagggcagggcaacatctatgtatatgttcagctgctccagcagaacagacagcatggcttccagctgggaccggggagaaaaccatttcgaagggggtgtgttcccctttttgggatgtggagggctgattctatgcatgtggagctgagcagcgggctgggctgtctgggaggctggcagccacaagctggggtgcaagtgggggacagcgggactgtgggcctgccctgggtgccttgcccgcccatcctggtgccgtcaccgacaaccaggacacccagcctcctgctgcgggctcagcacaggaaggggccaggccttctcggggggaaagggctctctctatgtcaacaaggcagaaacaccgagggtcacagctgagcagtgccctggctcacatctgtgatgggaggaggaggcagggaaccgaatcaggtcgtgagattcgtggtgagggacccagttggatgagtggaactgagagtgagaggctggggtcccactcttgtgcctggactttaccttcccttaatttcaccctcagtatggagtaggtgcctcccacagccaaccagggtccttactgagaaggggggtggtgaggctgggaatttggacattgtgacgtgatgaggggtataggcagtgactgggttctcatggcagacgacagcacagtggggcagacaggggtgactgcagtggccgtgggaaggacagggggctcgggacccgcctcccagacccctgcacactccagagatgccggtggcccaggcttggaaacgggtggacgtctcccaagaggcacaagtccttacaaagagaactggttagccctaaagtcccaggtctgcaaagtggccaaaatcatggctgcagttccaaccttcagaactcaataaaacagggtttctgtggagcagagggaagcccctcggctcaggccccctaccctgcagggagggaggaagaggccagcgccctccgacatcaaggtcagtcttttccaaggaggtcatccacggggtgccaccctcccgccagcttgccttctcttcttacccgccgccccttctcccacaggctgccctgcagagggtggcacatcaactcgcagcagaccctggccaccaaggacaggcagccgctcagtctgagacactgcaggtggcggaggccttggccctcccagtggcgcggaggagggcatctcctctccagcatgtggcttcctctcccactcccccttctcgtccttcctctcccctctgcccagcccctgccttggcctcccccatggcctcccgccccacccccacccgtcacactcacacaaggttgacatcgtctgcctgtggctccacgaacacaccaagtttcaaatcctttgttgctgccgctgcctctgtgacacccccacgacagggccagaggcggtgggcacccccagtctcttgaaatccccccgaagcagctttcacagcctctccttctccctcttctacatggagggggaaaaaaaaagaatcaaaaggaattgcccgaggaaatgttgggtgtggccatgtttttgaatgttttttaaaaaatattttattattagcccaccgatcaatttggaaagatgcaatttgctcttattcccatcactgattttgaagtcccgagccaaagccgagcgataaaagccggttaagtgatgaaccgattaaccgaactgcgaggagcagctgggggcagagggcggggccgggtcattattctttttttttccacactctcactctctcttctctccacgattattgaccgccccgggggcctgatcacaaaccctgcttggccagggaggcagacacctcgtcggctagcgtggcgagctggggcgagtctaccatgtcgatgctgccggtggaggagacattgctgaggtgccgtggagacgtgtccccagacaccaccggcgacttgtacacgatttccgccccgtggtctgtcttggctttggcgttctcgcggaaggtcagcttgtgggtttcaatctttttatttcctccgccagggacatgggtgatattgtccagggacccgatcttcgactgcactctgtccttgaagtccagcttctcagattttacttccacctggccacctcctggtttatgatggatgttgcctaatgagccacacttggaggtcaccttgctcaggtcaactggtttgtagactatttgcacactgccgcctcccgggacgtgtttgatattatcctttgagccacacttggactggacgttgctaagatccagcttcttattaattatctgcaccttcccgcctcccggctggtgcttcaggttctcggtggagccgatcttggacttgacgttcttcaggtctggcatgggcacgggggctgtctgcaggcggctcttggcggaagacggcgacttaggtggagtacggaccaccgccaccttcttgggctcccgggctggaggggttggaagggacggggtgcgggagcggctgccgggagtgcccggggagccggggctgctgtagccactgcgatcccctgattttggaggttcaccagagctgggtggtgtctttggggcgggcggggtttttgctggaatcctggtggcgttggcttggcccttctggcctggaggggccgctccccggggtgtggcgatcttcgttttcccatcagcccccttggcttttttgtcatcgcttccagtcccgtctttgcttttactgaccatgcgagcttgggtcacgtgaccagcagcttcgtcttccaggctgggggtgtctccgatgcctgcttcctcagctgtggttccttctgggatctccatgtggggctgggcggcagcctgctcgccgggagctctctcatccactaagggcgctgtcacatcttccgccgttggagtgctcttagcatcagaggtttcagagcccagttcctcagatccatcctcagcgggggtctgcaggggagattctttcaggccagcgtccgtgtcaccctcttggtcttggagcatggtgtagccctcttgatctttcctgtcccccaacccgtacgtcccagcgtgatcttccatcacatcgaactcctggcggggctcagccatcctggttcaaggctcgcctgatagtcgacagaggcgaggacgggagaggacagcggaggaggagaaggtggctgtggtggcggcggcagaaggtgggcggtggcagcggcgctgctgttggtgccggagctggtgggtggcggtgactgcgagggcgcgcgccggggaagagggcgcgttcccgaggccggcaggcggcgcaggcgcgagcagcgggagcgcgagcctccccaggggagggggcgggcagcccggcctccgcgggagccttctcctccggccaccagtgggcgcgcgcgagcgccctgccgctcggc

SEQ ID NO: 9 - RNA, 5272 nt, Rattus norvegicus
  source 1..5272: mol_type = other RNA
accgcccaccttctgctgtcgccgccgccacaaccaccttcccctccgctgtcctcttctgtcctcgcctcctgtcgattatcaggctttgaagcagcatggctgaaccccgccaggagtttgacacaatggaagaccaggccggagattacactatgctccaagaccaagaaggagacatggaccatggcttaaaagagtctcccccacagcccccagccgatgatggatcagaagaaccagggtcggagacctctgatgctaagagcactccaactgctgaagacgtgactgcgcccctagtggaagagagagctcccgacaagcaggcgactgcccagtcccacacggagatcccagaaggcaccacagctgaagaagcaggcatcggagacaccccgaacatggaggaccaagctgctgggcatgtgactcaagctcgagtggccggcgtaagcaaagacaggacaggaaatgacgagaagaaagccaagggcgccgatggcaaaacgggggcgaagatcgccacacctcggggagcagccactccgggccagaaaggcacatccaatgccaccaggatcccagccaagaccacacccagcccaaagactcctccaggatcaggtgaaccaccaaaatccggagaacgaagcggctacagcagccccggctcgcccggaacccctggcagtcgctcccgtaccccatccctaccaacgccgcccacccgagagcccaaaaaggtggcagtggttcgcactccccctaagtcaccgtctgccagtaagagccgcctacagactgcccctgtgcccatgccagacctaaagaacgtcaggtccaagattggctccactgagaacctgaagcaccagccgggaggcggcaaggtgcagataattaataagaagctggatcttagcaacgtccagtccaagtgtggctcaaaggacaatatcaaacacgtcccgggcggaggcagtgtgcaaatagtctacaagccagtggacctgagcaaggtgacctccaagtgtggttccttagggaacatccatcacaagccaggaggtggccaggtagaagtaaaatcagagaagctggacttcaaggatagagtccagtcgaagattggctccttggataacatcacccatgtccctggaggagggaataagaagattgaaacccacaagctgaccttcagggagaatgccaaagccaagacagaccatggagcagaaatcgtgtacaagtcacctgtggtgtctggggacacatctccacggcacctcagcaacgtctcctccacgggcagcatcgacatggtggactctccacagcttgccacgttagccgatgaagtgtccgcctctttggccaagcagggtttgtgatcaggcccctggggccgtcactgatcatggagagaagagagagtgagagtgtggaaaaaaaaaaaaaaaaaagaatgacctggcccctcaccctctgccctccccgctgctcctcatagacaggctgaccagcttgtcacctaacctgcttttgtggctcgggtttggctcgggacttcaaaatcagtgatgggaaaaagtaaatttcatctttccaaattgatttgtgggctagtaataaaatatttttaaggaaggaaaaaaaaaaaaacacgtaaaaccatggccaaacaaaacccaacatttccttggcaattgttattgaccccgccccccccctctgagttttagagggtgaaggaggctttggatggaggctgcttctggggattggctgagggactagggcaactaattgcccacagccccatcttaggggcatcagggacagcggcagcaatgaaagacttgggacttggtgtgtttgtggagccgtaggcaggtgatgttaactttgtgtgggtttgagggaggactgtgatagtgaaggctgagagatgggtgggctgggagtcagaggagagaggtgaggaagacaggttgggagaggggacattggctccttgccaaggagcttgggaagcacaggtagccctggctgcctgcagcagtcttagctagcacagatgcctgcctgagaaagcacagtggggtacagtgggtgtgtgtgccccttctgaagggcagcccatgggagaaggggtattgggcagaaggaaggtaggccagaaggtggcaccttgtagattggttctctgaaggctgaccttgccatcccagggcactggctcccaccctccagggagggaggtcctgagctgaggagcttccctttgctctcacaggaaaacctgtgttactgagttctgaagtttggaactacagccatgattttggccaccatacagacctgggactttagggctaaccagttctttgtaaggacttgtgcctcttgcgggaacatctgcctgttctcaagcctggtcctctggcacttctgcagtgtgagggatgggggtggtaattctgggatgtgggtcccaggcctcccatcctcgcacagccactgtatcccctctacctgtcctatcatgcccacgtctgccatgagagccagtcactgccgtccgtacatcacgtctcaccgtcctgagtgcccagcctccccaagccccatccctggcccctgggtagttatggccaatatctgctctacactaggggttggagtccagggaaggcaaagatttgggccttggtctctagtcctacgttgcacgaatccaaccagtgtgcctcccacaaggaaccttacaaccttgtttggtttgctccatcatttcccatcgtggatgggagtccgtgtgtgcctggagattaccctggacacctctgcttttttttttttactttagcggttgcctcctaggcctgactccttcccatgttgaactggaggcagccacgttaggtgtcaatgtcctggcatcagtatgaacagtcagtagtcccagggcagggccacacttctcccatcttctgcttccaccccagcttgtgattgctagcctcccagagctcagccgccattaagtccccatgcacgtaatcagcccttcataccccaatttggggaacataccccttgattgaaatgttttccctccagtcctatggaagcggtgctgcctgccctgctggagcagccagccatctccagagacgcagccctttctctcctgtccgcaccctgttgcgctgtagtcggattcgtctgtttgtctgggttcaccagagtgactatgatagtgaaaagaaaaagaaaaagaaaaaagaaaaaagaaaaaaaaaaaaggacgcatgttatcttgaaatatttgtcaaaaggttgtagcccaccgcagggattggagggcctggatattccttgtcttcttcgtgacttaggtccaggccggtgcagtgctaccctgctgggacatcccatgttttgaagggtttcttcttcatctgggaccctgcagacactggattgtgacattggaggtctatgacattggccaaggcctgaagcacaggacccgttagaggcagcaggctccgactgtcagggagagcttgtggctggcctgtttctctgagtgaagatggtcctctctaatcacaacttcaagtcccacagcagccctggcagacatctaagaactcctgcatcacaagagaaaaggacactagtaccagcagggagagctgtggccctagaaattccatgactctccactacatatccgtgggtcctttccaagccttggcctcgtcaccaagggcttgggatggactgccccactgatgaaagggacatctttggagacccccttggtttccaaggcgtcagccccctgaccttgcatgacctcctacagctgtaaggatgaggcctttaaagattaggaacctcaggcccaggtcggccactttgggcttgggtacagttagggacgatgcggtagaaggaggtggccaacctttcccatataagagttctgtgtgcccagagctaccctattgtgagctccccactgctgatggactttagctgtccttagaagtgaagagtccaacggaggaaaaggaagtgtggtttgatggtctgtggtcccttcatcatggttacctgttgtggttttctctcgtatacccatttacccatcctgcagttcctgtccttgaataggggtgggggtactctgccatatctcttgtagggcagtcagcccccaagtcatagtttggagtgatctggtcagtgctaataggcagtttacaaaggaattctggcttgttacttcagtgaggacaatcccccaagggccctggcacctgtcctgtctttccatggctctccactgcagagccaatgtctttgggtgggctagatagggtgtacaatttgcctggttcctccaagctcttaatccactttatcaatagttccatttaaattgacttcaatgataagagtgtatcccatttgagattgcttgtgttgtggggtaaaggggggaggaggaacatgttaagataattgacatgggcaaggggaagtcttgaagtgtagcagttaaaccatcttgtagccccattcatgatgttgaccacttgctagagagaagaggtgccataaggctagaacctagaggcttggctgtcccaccaacaggcaggcttttgcaaggcagaggcagccagctaggtccctgacttcccagccaggtgcagctctaagaactgctcttgcctgctgccttcttgtggtgtccagagcccacagccaatgcctcctcaaaaccctggcttccttccttctaatccactggcacatcagcatcacctccggattgacttcagatccacagcctacactactagcagtgggtaagaccacttcctttgtccttgtctgttctccagaaaagtgggcatggaggcggtgttaataactataggtctgtggctttatgagccttcaaacttctctctagcttctgaaagggttacttttgggcagtattgcagtctcaccctcccgatgggctgtagcctgtgcagttgctgtactgggcatgatctccagtgcttgcaagtcccatgatttctttggtgattttgagggtggggggagggacatgaatcatcttagcttagcttcctgtctgtgaatgtccatatagtgtactgtgttttaacaaacgatttacactgactgttgctgtacaagtgaatttggaaataaagttattactctgattaaa

SEQ ID NO: 10 - RNA, 5272 nt, Rattus norvegicus
  source 1..5272: mol_type = other RNA
tttaatcagagtaataactttatttccaaattcacttgtacagcaacagtcagtgtaaatcgtttgttaaaacacagtacactatatggacattcacagacaggaagctaagctaagatgattcatgtccctccccccaccctcaaaatcaccaaagaaatcatgggacttgcaagcactggagatcatgcccagtacagcaactgcacaggctacagcccatcgggagggtgagactgcaatactgcccaaaagtaaccctttcagaagctagagagaagtttgaaggctcataaagccacagacctatagttattaacaccgcctccatgcccacttttctggagaacagacaaggacaaaggaagtggtcttacccactgctagtagtgtaggctgtggatctgaagtcaatccggaggtgatgctgatgtgccagtggattagaaggaaggaagccagggttttgaggaggcattggctgtgggctctggacaccacaagaaggcagcaggcaagagcagttcttagagctgcacctggctgggaagtcagggacctagctggctgcctctgccttgcaaaagcctgcctgttggtgggacagccaagcctctaggttctagccttatggcacctcttctctctagcaagtggtcaacatcatgaatggggctacaagatggtttaactgctacacttcaagacttccccttgcccatgtcaattatcttaacatgttcctcctcccccctttaccccacaacacaagcaatctcaaatgggatacactcttatcattgaagtcaatttaaatggaactattgataaagtggattaagagcttggaggaaccaggcaaattgtacaccctatctagcccacccaaagacattggctctgcagtggagagccatggaaagacaggacaggtgccagggcccttgggggattgtcctcactgaagtaacaagccagaattcctttgtaaactgcctattagcactgaccagatcactccaaactatgacttgggggctgactgccctacaagagatatggcagagtacccccacccctattcaaggacaggaactgcaggatgggtaaatgggtatacgagagaaaaccacaacaggtaaccatgatgaagggaccacagaccatcaaaccacacttccttttcctccgttggactcttcacttctaaggacagctaaagtccatcagcagtggggagctcacaatagggtagctctgggcacacagaactcttatatgggaaaggttggccacctccttctaccgcatcgtccctaactgtacccaagcccaaagtggccgacctgggcctgaggttcctaatctttaaaggcctcatccttacagctgtaggaggtcatgcaaggtcagggggctgacgccttggaaaccaagggggtctccaaagatgtccctttcatcagtggggcagtccatcccaagcccttggtgacgaggccaaggcttggaaaggacccacggatatgtagtggagagtcatggaatttctagggccacagctctccctgctggtactagtgtccttttctcttgtgatgcaggagttcttagatgtctgccagggctgctgtgggacttgaagttgtgattagagaggaccatcttcactcagagaaacaggccagccacaagctctccctgacagtcggagcctgctgcctctaacgggtcctgtgcttcaggccttggccaatgtcatagacctccaatgtcacaatccagtgtctgcagggtcccagatgaagaagaaacccttcaaaacatgggatgtcccagcagggtagcactgcaccggcctggacctaagtcacgaagaagacaaggaatatccaggccctccaatccctgcggtgggctacaaccttttgacaaatatttcaagataacatgcgtccttttttttttttcttttttcttttttctttttctttttcttttcactatcatagtcactctggtgaacccagacaaacagacgaatccgactacagcgcaacagggtgcggacaggagagaaagggctgcgtctctggagatggctggctgctccagcagggcaggcagcaccgcttccataggactggagggaaaacatttcaatcaaggggtatgttccccaaattggggtatgaagggctgattacgtgcatggggacttaatggcggctgagctctgggaggctagcaatcacaagctggggtggaagcagaagatgggagaagtgtggccctgccctgggactactgactgttcatactgatgccaggacattgacacctaacgtggctgcctccagttcaacatgggaaggagtcaggcctaggaggcaaccgctaaagtaaaaaaaaaaaagcagaggtgtccagggtaatctccaggcacacacggactcccatccacgatgggaaatgatggagcaaaccaaacaaggttgtaaggttccttgtgggaggcacactggttggattcgtgcaacgtaggactagagaccaaggcccaaatctttgccttccctggactccaacccctagtgtagagcagatattggccataactacccaggggccagggatggggcttggggaggctgggcactcaggacggtgagacgtgatgtacggacggcagtgactggctctcatggcagacgtgggcatgataggacaggtagaggggatacagtggctgtgcgaggatgggaggcctgggacccacatcccagaattaccacccccatccctcacactgcagaagtgccagaggaccaggcttgagaacaggcagatgttcccgcaagaggcacaagtccttacaaagaactggttagccctaaagtcccaggtctgtatggtggccaaaatcatggctgtagttccaaacttcagaactcagtaacacaggttttcctgtgagagcaaagggaagctcctcagctcaggacctccctccctggagggtgggagccagtgccctgggatggcaaggtcagccttcagagaaccaatctacaaggtgccaccttctggcctaccttccttctgcccaataccccttctcccatgggctgcccttcagaaggggcacacacacccactgtaccccactgtgctttctcaggcaggcatctgtgctagctaagactgctgcaggcagccagggctacctgtgcttcccaagctccttggcaaggagccaatgtcccctctcccaacctgtcttcctcacctctctcctctgactcccagcccacccatctctcagccttcactatcacagtcctccctcaaacccacacaaagttaacatcacctgcctacggctccacaaacacaccaagtcccaagtctttcattgctgccgctgtccctgatgcccctaagatggggctgtgggcaattagttgccctagtccctcagccaatccccagaagcagcctccatccaaagcctccttcaccctctaaaactcagagggggggggcggggtcaataacaattgccaaggaaatgttgggttttgtttggccatggttttacgtgtttttttttttttccttccttaaaaatattttattactagcccacaaatcaatttggaaagatgaaatttactttttcccatcactgattttgaagtcccgagccaaacccgagccacaaaagcaggttaggtgacaagctggtcagcctgtctatgaggagcagcggggagggcagagggtgaggggccaggtcattcttttttttttttttttttccacactctcactctctcttctctccatgatcagtgacggccccaggggcctgatcacaaaccctgcttggccaaagaggcggacacttcatcggctaacgtggcaagctgtggagagtccaccatgtcgatgctgcccgtggaggagacgttgctgaggtgccgtggagatgtgtccccagacaccacaggtgacttgtacacgatttctgctccatggtctgtcttggctttggcattctccctgaaggtcagcttgtgggtttcaatcttcttattccctcctccagggacatgggtgatgttatccaaggagccaatcttcgactggactctatccttgaagtccagcttctctgattttacttctacctggccacctcctggcttgtgatggatgttccctaaggaaccacacttggaggtcaccttgctcaggtccactggcttgtagactatttgcacactgcctccgcccgggacgtgtttgatattgtcctttgagccacacttggactggacgttgctaagatccagcttcttattaattatctgcaccttgccgcctcccggctggtgcttcaggttctcagtggagccaatcttggacctgacgttctttaggtctggcatgggcacaggggcagtctgtaggcggctcttactggcagacggtgacttagggggagtgcgaaccactgccacctttttgggctctcgggtgggcggcgttggtagggatggggtacgggagcgactgccaggggttccgggcgagccggggctgctgtagccgcttcgttctccggattttggtggttcacctgatcctggaggagtctttgggctgggtgtggtcttggctgggatcctggtggcattggatgtgcctttctggcccggagtggctgctccccgaggtgtggcgatcttcgcccccgttttgccatcggcgcccttggctttcttctcgtcatttcctgtcctgtctttgcttacgccggccactcgagcttgagtcacatgcccagcagcttggtcctccatgttcggggtgtctccgatgcctgcttcttcagctgtggtgccttctgggatctccgtgtgggactgggcagtcgcctgcttgtcgggagctctctcttccactaggggcgcagtcacgtcttcagcagttggagtgctcttagcatcagaggtctccgaccctggttcttctgatccatcatcggctgggggctgtgggggagactcttttaagccatggtccatgtctccttcttggtcttggagcatagtgtaatctccggcctggtcttccattgtgtcaaactcctggcggggttcagccatgctgcttcaaagcctgataatcgacaggaggcgaggacagaagaggacagcggaggggaaggtggttgtggcggcggcgacagcagaaggtgggcggt

SEQ ID NO: 11 - RNA, 1487 nt, Canis lupus
  source 1..1487: mol_type = other RNA
cgcgctcgcgctctcagccacccaccagctcccgcaccagcagcagcagcgccgccgccgccgccgccgccgccgccgcccaccttctgctgccgccaccacagccactttctcctctttcctctcctgtcctcgccctctgtcgactatcaggtgggccttgacctaggatggctgagccccgccaggagttcactgtgatggaagatcatgctgggacatacgggaaagatctcccctctcaggggggctacaccctgctgcaagaccatgagggggacgtggatcacggcctgaaagctgaagaagcaggcattggagacacccccaacctggaagaccaagctgctggacatgtgactcaagctcgcatggtcagtaaaggcaaagatgggactggaaccgatgacaaaaaagccaagggggctgatggtaaaactggaacgaagatcgccacaccccggggagcgaccccttcaggccagaaaggccaggccaatgccaccaggattccagcgaaaaccacgccctcccccaagaccccaccgggcggtgaatctggaaaatctggggatcgcagtggctacagcagccccggctccccaggcactcctggcagccgctcccgcaccccgtccctgccaaccccacccacccgggagcccaagaaggtggcggtggtccgcaccccacccaagtcgccgtctgcagccaagagtcgcctgcagaccgcccctgtgcccatgccagacctaaagaacgtcagatccaagatcggctccactgaaaacctgaagcaccagccaggaggtgggaaggtgcaaatagtgtacaaaccagtggatctgagcaaggtgacctccaagtgcggctcattaggcaacatccatcataagccaggaggcggtcaggtggaagtcaaatctgagaagctggacttcaaggacagagtccagtcgaagatcgggtccctggacaacatcacccacgtccctggcggagggaataaaaagatcgaaacccacaagctgaccttccgtgagaacgccaaagccaagaccgaccacggggcggagatcgtgtacaagtcgcccgtggtgtccggggacacgtctccgcggcacctgagcaacgtgtcctccacgggcagcatcgacatggtcgactcgccccagctcgccacgctagccgacgaagtgtccgcctccctggccaagcagggtttgtgatcaggcccccggggcggtcaatgatcgtggagagaagagagtgtggaaaaaaaaagaataatgatctggcccttctcgccctctgccctcccccagctgctcctcacagaccggttaatcggttaatcacttaacctgcttttgtcgctcggctctggctcgggacttcaaaatcagtgacgggaaaaagcaaatttcatctttccaaattgatgggtgggctaataataataaaatatttttaaaaccatttaaaaa

SEQ ID NO: 12 - RNA, 1487 nt, Canis lupus
  source 1..1487: mol_type = other RNA
tttttaaatggttttaaaaatattttattattattagcccacccatcaatttggaaagatgaaatttgctttttcccgtcactgattttgaagtcccgagccagagccgagcgacaaaagcaggttaagtgattaaccgattaaccggtctgtgaggagcagctgggggagggcagagggcgagaagggccagatcattattctttttttttccacactctcttctctccacgatcattgaccgccccgggggcctgatcacaaaccctgcttggccagggaggcggacacttcgtcggctagcgtggcgagctggggcgagtcgaccatgtcgatgctgcccgtggaggacacgttgctcaggtgccgcggagacgtgtccccggacaccacgggcgacttgtacacgatctccgccccgtggtcggtcttggctttggcgttctcacggaaggtcagcttgtgggtttcgatctttttattccctccgccagggacgtgggtgatgttgtccagggacccgatcttcgactggactctgtccttgaagtccagcttctcagatttgacttccacctgaccgcctcctggcttatgatggatgttgcctaatgagccgcacttggaggtcaccttgctcagatccactggtttgtacactatttgcaccttcccacctcctggctggtgcttcaggttttcagtggagccgatcttggatctgacgttctttaggtctggcatgggcacaggggcggtctgcaggcgactcttggctgcagacggcgacttgggtggggtgcggaccaccgccaccttcttgggctcccgggtgggtggggttggcagggacggggtgcgggagcggctgccaggagtgcctggggagccggggctgctgtagccactgcgatccccagattttccagattcaccgcccggtggggtcttgggggagggcgtggttttcgctggaatcctggtggcattggcctggcctttctggcctgaaggggtcgctccccggggtgtggcgatcttcgttccagttttaccatcagcccccttggcttttttgtcatcggttccagtcccatctttgcctttactgaccatgcgagcttgagtcacatgtccagcagcttggtcttccaggttgggggtgtctccaatgcctgcttcttcagctttcaggccgtgatccacgtccccctcatggtcttgcagcagggtgtagcccccctgagaggggagatctttcccgtatgtcccagcatgatcttccatcacagtgaactcctggcggggctcagccatcctaggtcaaggcccacctgatagtcgacagagggcgaggacaggagaggaaagaggagaaagtggctgtggtggcggcagcagaaggtgggcggcggcggcggcggcggcggcggcggcgctgctgctgctggtgcgggagctggtgggtggctgagagcgcgagcgcg

SEQ ID NO: 13 - RNA, 21 nt, synthetic construct
  source 1..21: mol_type = other RNA
acgtgacccaagctcgcatga

SEQ ID NO: 14 - RNA, 21 nt, synthetic construct
  source 1..21: mol_type = other RNA
gtgacccaagctcgcatggta

SEQ ID NO: 15 - RNA, 21 nt, synthetic construct
  source 1..21: mol_type = other RNA
tgacccaagctcgcatggtca

SEQ ID NO: 16 - RNA, 21 nt, synthetic construct
  source 1..21: mol_type = other RNA
acccaagctcgcatggtcaga

SEQ ID NO: 17 - RNA, 21 nt, synthetic construct
  source 1..21: mol_type = other RNA
atagtctacaaaccagttgaa

SEQ ID NO: 18 - RNA, 21 nt, synthetic construct
  source 1..21: mol_type = other RNA
gtctacaaaccagttgaccta

SEQ ID NO: 19 - RNA, 21 nt, synthetic construct
  source 1..21: mol_type = other RNA
atctgagaagcttgacttcaa

SEQ ID NO: 20 - RNA, 21 nt, synthetic construct
  source 1..21: mol_type = other RNA
gaaataaagttattactctga

SEQ ID NO: 21 - RNA, 21 nt, synthetic construct
  source 1..21: mol_type = other RNA
gctcgcatggtcagtaaaaga

SEQ ID NO: 22 - RNA, 21 nt, synthetic construct
  source 1..21: mol_type = other RNA
ctcgcatggtcagtaaaagca

SEQ ID NO: 23 - RNA, 21 nt, synthetic construct
  source 1..21: mol_type = other RNA
atggtcagtaaaagcaaagaa

SEQ ID NO: 24 - RNA, 21 nt, synthetic construct
  source 1..21: mol_type = other RNA
gtcagtaaaagcaaagacgga

SEQ ID NO: 25 - RNA, 21 nt, synthetic construct
  source 1..21: mol_type = other RNA
tcagtaaaagcaaagacggga

SEQ ID NO: 26 - RNA, 21 nt, synthetic construct
  source 1..21: mol_type = other RNA
cagtaaaagcaaagacgggaa

SEQ ID NO: 27 - RNA, 21 nt, synthetic construct
  source 1..21: mol_type = other RNA
gcaaatagtctacaaaccaga

SEQ ID NO: 28 - RNA, 21 nt, synthetic construct
  source 1..21: mol_type = other RNA
aaatagtctacaaaccagtta

SEQ ID NO: 29 - RNA, 21 nt, synthetic construct
  source 1..21: mol_type = other RNA
aatagtctacaaaccagttga

SEQ ID NO: 30 - RNA, 21 nt, synthetic construct
  source 1..21: mol_type = other RNA
tagtctacaaaccagttgaca

SEQ ID NO: 31 - RNA, 21 nt, synthetic construct
  source 1..21: mol_type = other RNA
tacaaaccagttgacctgaga

SEQ ID NO: 32 - RNA, 21 nt, synthetic construct
  source 1..21: mol_type = other RNA
acaaaccagttgacctgagca

SEQ ID NO: 33 - RNA, 21 nt, synthetic construct
  source 1..21: mol_type = other RNA
tgaatttggaaataaagttaa

SEQ ID NO: 34 - RNA, 21 nt, synthetic construct
  source 1..21: mol_type = other RNA
tgaatttggaaataaagttaa

SEQ ID NO: 35 - RNA, 21 nt, synthetic construct
  source 1..21: mol_type = other RNA
gaatttggaaataaagttata

SEQ ID NO: 36 - RNA, 21 nt, synthetic construct
  source 1..21: mol_type = other RNA
aatttggaaataaagttatta

SEQ ID NO: 37 - RNA, 21 nt, synthetic construct
  source 1..21: mol_type = other RNA
atttggaaataaagttattaa

SEQ ID NO: 38 - RNA, 21 nt, synthetic construct
  source 1..21: mol_type = other RNA
atttggaaataaagttattaa

SEQ ID NO: 39 - RNA, 21 nt, synthetic construct
  source 1..21: mol_type = other RNA
ggaaataaagttattactcta

SEQ ID NO: 40 - RNA, 21 nt, synthetic construct
  source 1..21: mol_type = other RNA
taaagttattactctgattaa

SEQ ID NO: 41 - RNA, 21 nt, synthetic construct
  source 1..21: mol_type = other RNA
gtgacccaagctcgcatggta

SEQ ID NO: 42 - RNA, 21 nt, synthetic construct
  source 1..21: mol_type = other RNA
gtgacccaagctcgcatggta

SEQ ID NO: 43 - RNA, 21 nt, synthetic construct
  source 1..21: mol_type = other RNA
gtgacccaagctcgcatggta

SEQ ID NO: 44 - RNA, 21 nt, synthetic construct
  source 1..21: mol_type = other RNA
  modified_base 12: mod_base = OTHER; note = 5'-methyluridine-3'-phosphate
gtgacccaagctcgcatggta

SEQ ID NO: 45 - RNA, 21 nt, synthetic construct
  source 1..21: mol_type = other RNA
gtgacccaagctcgcatggta

SEQ ID NO: 46 - RNA, 21 nt, synthetic construct
  source 1..21: mol_type = other RNA
gtgacccaagctcgcatggta

SEQ ID NO: 47 - RNA, 21 nt, synthetic construct
  source 1..21: mol_type = other RNA
gtgagccaagctcgcatggta

SEQ ID NO: 48 - RNA, 21 nt, synthetic construct
  source 1..21: mol_type = other RNA
gtgaaccaagctcgcatggta

SEQ ID NO: 49 - RNA, 21 nt, synthetic construct
  source 1..21: mol_type = other RNA
gtgtcccaagctcgcatggta

SEQ ID NO: 50 - RNA, 21 nt, synthetic construct
  source 1..21: mol_type = other RNA
gtcacccaagctcgcatggta

SEQ ID NO: 51 - RNA, 21 nt, synthetic construct
  source 1..21: mol_type = other RNA
gttacccaagctcgcatggta

SEQ ID NO: 52 - RNA, 21 nt, synthetic construct
  source 1..21: mol_type = other RNA
gtgacccaagctcgcatggta

SEQ ID NO: 53 - RNA, 21 nt, synthetic construct
  source 1..21: mol_type = other RNA
gtgacccaagctcgcatggta

SEQ ID NO: 54 - RNA, 21 nt, synthetic construct
  source 1..21: mol_type = other RNA
gtgacccaagctcgcatggta

SEQ ID NO: 55 - RNA, 21 nt, synthetic construct
  source 1..21: mol_type = other RNA
gtgacccaagctcgcatggta

SEQ ID NO: 56 - RNA, 21 nt, synthetic construct
  source 1..21: mol_type = other RNA
gtgacccaagctcgcatggta

SEQ ID NO: 57 - RNA, 21 nt, synthetic construct
  source 1..21: mol_type = other RNA
gtgacccaagctcgcttggta

SEQ ID NO: 58 - RNA, 21 nt, synthetic construct
  source 1..21: mol_type = other RNA
gtgacccaagctcgtatggta

SEQ ID NO: 59 - RNA, 21 nt, synthetic construct
  source 1..21: mol_type = other RNA
gtgacccaagctcgcatggta

SEQ ID NO: 60 - RNA, 21 nt, synthetic construct
  source 1..21: mol_type = other RNA
gtgacccaagctcgcttggta

SEQ ID NO: 61 - RNA, 21 nt, synthetic construct
  source 1..21: mol_type = other RNA
gtgacccaagctcgtatggta

SEQ ID NO: 62 - RNA, 21 nt, synthetic construct
  source 1..21: mol_type = other RNA
tacaaaccagttgacctgaga

SEQ ID NO: 63 - RNA, 21 nt, synthetic construct
  source 1..21: mol_type = other RNA
tacaaaccagttgacctgaga

SEQ ID NO: 64 - RNA, 21 nt, synthetic construct
  source 1..21: mol_type = other RNA
tacaaaccagttgacctgaga

SEQ ID NO: 65 - RNA, 21 nt, synthetic construct
  source 1..21: mol_type = other RNA
tacaaaccagttgacctgaga

SEQ ID NO: 66 - RNA, 21 nt, synthetic construct
  source 1..21: mol_type = other RNA
tacaaaccagttgacctgaga

SEQ ID NO: 67 - RNA, 21 nt, synthetic construct
  source 1..21: mol_type = other RNA
tacaaaccagttgacctgaga

SEQ ID NO: 68 - RNA, 21 nt, synthetic construct
  source 1..21: mol_type = other RNA
tacaaaccagttgacctgaga

SEQ ID NO: 69 - RNA, 21 nt, synthetic construct
  source 1..21: mol_type = other RNA
tacaaaccagttgacctgaga

SEQ ID NO: 70 - RNA, 21 nt, synthetic construct
  source 1..21: mol_type = other RNA
tacaaaccagttgacctgaga

SEQ ID NO: 71 - RNA, 21 nt, synthetic construct
  source 1..21: mol_type = other RNA
tacaaaccagttgacgtgaga

SEQ ID NO: 72 - RNA, 21 nt, synthetic construct
  source 1..21: mol_type = other RNA
tacaaaccagttgacttgaga

SEQ ID NO: 73 - RNA, 21 nt, synthetic construct
  source 1..21: mol_type = other RNA
tacaaaccagttgatctgaga

SEQ ID NO: 74 - RNA, 21 nt, synthetic construct
  source 1..21: mol_type = other RNA
tacaaaccagttgacgtgaga

SEQ ID NO: 75 - RNA, 21 nt, synthetic construct
  source 1..21: mol_type = other RNA
tacaaaccagttgacttgaga

SEQ ID NO: 76 - RNA, 21 nt, synthetic construct
  source 1..21: mol_type = other RNA
tacaaaccagttgatctgaga

SEQ ID NO: 77 - RNA, 19 nt, synthetic construct
  source 1..19: mol_type = other RNA
caaaccagttgacctgaga

SEQ ID NO: 78 - RNA, 19 nt, synthetic construct
  source 1..19: mol_type = other RNA
caaaccagttgacctgaga

SEQ ID NO: 79 - RNA, 21 nt, synthetic construct
  source 1..21: mol_type = other RNA
gtctacaaaccagttgaccta

SEQ ID NO: 80 - RNA, 21 nt, synthetic construct
  source 1..21: mol_type = other RNA
gtctacaaaccagttgaccta

SEQ ID NO: 81 - RNA, 21 nt, synthetic construct
  source 1..21: mol_type = other RNA
gtcttcaaaccagttgaccta

SEQ ID NO: 82 - RNA, 21 nt, synthetic construct
  source 1..21: mol_type = other RNA
gtcaacaaaccagttgaccta

SEQ ID NO: 83 - RNA, 21 nt, synthetic construct
  source 1..21: mol_type = other RNA
gtgtacaaaccagttgaccta

SEQ ID NO: 84 - RNA, 21 nt, synthetic construct
  source 1..21: mol_type = other RNA
gtctacaaaccagttgaccta

SEQ ID NO: 85 - RNA, 21 nt, synthetic construct
  source 1..21: mol_type = other RNA
gtctacaaaccagttgaccta

SEQ ID NO: 86 - RNA, 21 nt, synthetic construct
  source 1..21: mol_type = other RNA
gtctacaaaccagtttaccta

SEQ ID NO: 87 - RNA, 21 nt, synthetic construct
  source 1..21: mol_type = other RNA
gtctacaaaccagtttaccta

SEQ ID NO: 88 - RNA, 21 nt, synthetic construct
  source 1..21: mol_type = other RNA
atagtctacaaaccagttgaa

SEQ ID NO: 89 - RNA, 21 nt, synthetic construct
  source 1..21: mol_type = other RNA
atagtctacaaaccagttgaa

SEQ ID NO: 90 - RNA, 21 nt, synthetic construct
  source 1..21: mol_type = other RNA
atagtctacaaaccagttgaa

SEQ ID NO: 91 - RNA, 21 nt, synthetic construct
  source 1..21: mol_type = other RNA
atagtctacaaaccagttgaa

SEQ ID NO: 92 - RNA, 21 nt, synthetic construct
  source 1..21: mol_type = other RNA
atagtctacaaaccagttgaa

SEQ ID NO: 93 - RNA, 20 nt, synthetic construct
  source 1..20: mol_type = other RNA
tagtctacaaaccagttgaa

SEQ ID NO: 94 - RNA, 19 nt, synthetic construct
  source 1..19: mol_type = other RNA
agtctacaaaccagttgaa

SEQ ID NO: 95 - RNA, 21 nt, synthetic construct
  source 1..21: mol_type = other RNA
atagactacaaaccagttgaa

SEQ ID NO: 96 - RNA, 21 nt, synthetic construct
  source 1..21: mol_type = other RNA
atactctacaaaccagttgaa

SEQ ID NO: 97 - RNA, 21 nt, synthetic construct
  source 1..21: mol_type = other RNA
attgtctacaaaccagttgaa

SEQ ID NO: 98 - RNA, 21 nt, synthetic construct
  source 1..21: mol_type = other RNA
atagtctacaaaccaattgaa

SEQ ID NO: 99 - RNA, 21 nt, synthetic construct
  source 1..21: mol_type = other RNA
atagtctacaaacctgttgaa

SEQ ID NO: 100 - RNA, 21 nt, synthetic construct
  source 1..21: mol_type = other RNA
atagtctacaaacccgttgaa

SEQ ID NO: 101 - RNA, 21 nt, synthetic construct
  source 1..21: mol_type = other RNA
atagtctacaaaccggttgaa

SEQ ID NO: 102 - RNA, 21 nt, synthetic construct
  source 1..21: mol_type = other RNA
aaatagtctacaaaccagtta

SEQ ID NO: 103 - RNA, 21 nt, synthetic construct
  source 1..21: mol_type = other RNA
aaatagtctacaaaccagtta

SEQ ID NO: 104 - RNA, 21 nt, synthetic construct
  source 1..21: mol_type = other RNA
aaatagtctacaaaccagtta

SEQ ID NO: 105 - RNA, 21 nt, synthetic construct
  source 1..21: mol_type = other RNA
aaatagtctacaaaccagtta

SEQ ID NO: 106 - RNA, 21 nt, synthetic construct
  source 1..21: mol_type = other RNA
aaattgtctacaaaccagtta

SEQ ID NO: 107 - RNA, 21 nt, synthetic construct
  source 1..21: mol_type = other RNA
aaaaagtctacaaaccagtta

SEQ ID NO: 108 - RNA, 21 nt, synthetic construct
  source 1..21: mol_type = other RNA
aattagtctacaaaccagtta

SEQ ID NO: 109 - RNA, 21 nt, synthetic construct
  source 1..21: mol_type = other RNA
aaatagtctacaaaccagtta

SEQ ID NO: 110 - RNA, 21 nt, synthetic construct
  source 1..21: mol_type = other RNA
aaatagtctacaaaccagtta

SEQ ID NO: 111 - RNA, 21 nt, synthetic construct
  source 1..21: mol_type = other RNA
aaatagtctacaaacgagtta

SEQ ID NO: 112 - RNA, 21 nt, synthetic construct
  source 1..21: mol_type = other RNA
gctcgcatggtcagtaaaaga

SEQ ID NO: 113 - RNA, 21 nt, synthetic construct
  source 1..21: mol_type = other RNA
gctcgcatggtcagtaaaaga

SEQ ID NO: 114 - RNA, 21 nt, synthetic construct
  source 1..21: mol_type = other RNA
gctcgcatggtcagtaaaaga

SEQ ID NO: 115 - RNA, 21 nt, synthetic construct
  source 1..21: mol_type = other RNA
gctcccatggtcagtaaaaga

SEQ ID NO: 116 - RNA, 21 nt, synthetic construct
  source 1..21: mol_type = other RNA
gctggcatggtcagtaaaaga

SEQ ID NO: 117 - RNA, 21 nt, synthetic construct
  source 1..21: mol_type = other RNA
gcacgcatggtcagtaaaaga

SEQ ID NO: 118 - RNA, 21 nt, synthetic construct
  source 1..21: mol_type = other RNA
gctcgcatggtcattaaaaga

SEQ ID NO: 119 - RNA, 21 nt, synthetic construct
  source 1..21: mol_type = other RNA
gctcgcatggtcagttaaaga

SEQ ID NO: 120 - RNA, 21 nt, synthetic construct
  source 1..21: mol_type = other RNA
gctcccatggtcactaaaaga

SEQ ID NO: 121 - RNA, 21 nt, synthetic construct
  source 1..21: mol_type = other RNA
gctcccatggtcagttaaaga

SEQ ID NO: 122 - RNA, 21 nt, synthetic construct
  source 1..21: mol_type = other RNA
gctggcatggtcactaaaaga

SEQ ID NO: 123 - RNA, 21 nt, synthetic construct
  source 1..21: mol_type = other RNA
gctggcatggtcagttaaaga

SEQ ID NO: 124 - RNA, 21 nt, synthetic construct
  source 1..21: mol_type = other RNA
gcacgcatggtcactaaaaga

SEQ ID NO: 125 - RNA, 21 nt, synthetic construct
  source 1..21: mol_type = other RNA
gcacgcatggtcagttaaaga

SEQ ID NO: 126 - RNA, 21 nt, synthetic construct
  source 1..21: mol_type = other RNA
atctgagaagcttgacttcaa

SEQ ID NO: 127 - RNA, 21 nt, synthetic construct
  source 1..21: mol_type = other RNA
atctgagaagcttgacttcaa

SEQ ID NO: 128 - RNA, 21 nt, synthetic construct
  source 1..21: mol_type = other RNA
atctgagaagcttgacttcaa

SEQ ID NO: 129 - RNA, 21 nt, synthetic construct
  source 1..21: mol_type = other RNA
atctgagaagcttgacttcaa

SEQ ID NO: 130 - RNA, 21 nt, synthetic construct
  source 1..21: mol_type = other RNA
atctgagaagcttgacttcaa

SEQ ID NO: 131 - RNA, 21 nt, synthetic construct
  source 1..21: mol_type = other RNA
atctcagaagcttgacttcaa

SEQ ID NO: 132 - RNA, 21 nt, synthetic construct
  source 1..21: mol_type = other RNA
atcttagaagcttgacttcaa

SEQ ID NO: 133 - RNA, 21 nt, synthetic construct
  source 1..21: mol_type = other RNA
atcagagaagcttgacttcaa

SEQ ID NO: 134 - RNA, 21 nt, synthetic construct
  source 1..21: mol_type = other RNA
atgtgagaagcttgacttcaa

SEQ ID NO: 135 - RNA, 21 nt, synthetic construct
  source 1..21: mol_type = other RNA
atatgagaagcttgacttcaa

SEQ ID NO: 136 - RNA, 21 nt, synthetic construct
  source 1..21: mol_type = other RNA
atctgagaagcttgatttcaa

SEQ ID NO: 137 - RNA, 19 nt, synthetic construct
  source 1..19: mol_type = other RNA
ccgagaagcttgacttcaa

SEQ ID NO: 138 - RNA, 19 nt, synthetic construct
  source 1..19: mol_type = other RNA
ccgagaagcttgacttcaa

SEQ ID NO: 139 - RNA, 21 nt, synthetic construct
  source 1..21: mol_type = other RNA
atggtcagtaaaagcaaagaa

SEQ ID NO: 140 - RNA, 21 nt, synthetic construct
  source 1..21: mol_type = other RNA
atggtcagtaaaagcaaagaa

SEQ ID NO: 141 - RNA, 21 nt, synthetic construct
  source 1..21: mol_type = other RNA
atggtcagtaaaagcaaagaa

SEQ ID NO: 142 - RNA, 21 nt, synthetic construct
  source 1..21: mol_type = other RNA
  modified_base 9: mod_base = OTHER; note = 5'-methyluridine-3'-phosphate
atggtcagtaaaagcaaagaa

SEQ ID NO: 143 - RNA, 21 nt, synthetic construct
  source 1..21: mol_type = other RNA
  modified_base 9: mod_base = OTHER; note = 5'-methyluridine-3'-phosphate
atggtcagtaaaagcaaagaa

SEQ ID NO: 144 - RNA, 21 nt, synthetic construct
  source 1..21: mol_type = other RNA
atggacagtaaaagcaaagaa

SEQ ID NO: 145 - RNA, 21 nt, synthetic construct
  source 1..21: mol_type = other RNA
atgctcagtaaaagcaaagaa

SEQ ID NO: 146 - RNA, 21 nt, synthetic construct
  source 1..21: mol_type = other RNA
atcgtcagtaaaagcaaagaa

SEQ ID NO: 147 - RNA, 21 nt, synthetic construct
  source 1..21: mol_type = other RNA
atggtcagtaaaagcaaagaa

SEQ ID NO: 148 - RNA, 21 nt, synthetic construct
  source 1..21: mol_type = other RNA
atggtcagtaaaagcaaagaa

SEQ ID NO: 149 - RNA, 21 nt, synthetic construct
  source 1..21: mol_type = other RNA
atggtcagtaaaagcaaagaa

SEQ ID NO: 150 - RNA, 21 nt, synthetic construct
  source 1..21: mol_type = other RNA
atggtcagtaaaagcgaagaa

SEQ ID NO: 151 - RNA, 21 nt, synthetic construct
  source 1..21: mol_type = other RNA
atggtcagtaaaagtaaagaa

SEQ ID NO: 152 - RNA, 21 nt, synthetic construct
  source 1..21: mol_type = other RNA
atggtcagtaaaagaaaagaa

SEQ ID NO: 153 - RNA, 21 nt, synthetic construct
  source 1..21: mol_type = other RNA
gcaaaccagttgacctgagca

SEQ ID NO: 154 - RNA, 21 nt, synthetic construct
  source 1..21: mol_type = other RNA
gcaatccagttgacctgagca

SEQ ID NO: 155 - RNA, 21 nt, synthetic construct
  source 1..21: mol_type = other RNA
gcataccagttgacctgagca

SEQ ID NO: 156 - RNA, 21 nt, synthetic construct
  source 1..21: mol_type = other RNA
gctaaccagttgacctgagca

SEQ ID NO: 157 - RNA, 21 nt, synthetic construct
  source 1..21: mol_type = other RNA
gcaaaccagttgacttgagca

SEQ ID NO: 158 - RNA, 21 nt, synthetic construct
  source 1..21: mol_type = other RNA
gcaatccagttgacttgagca

SEQ ID NO: 159 - RNA, 21 nt, synthetic construct
  source 1..21: mol_type = other RNA
gcataccagttgacttgagca

SEQ ID NO: 160 - RNA, 21 nt, synthetic construct
  source 1..21: mol_type = other RNA
gctaaccagttgacttgagca

SEQ ID NO: 161 - RNA, 21 nt, synthetic construct
  source 1..21: mol_type = other RNA
gcaaaccagttgacctgagca

SEQ ID NO: 162 - RNA, 21 nt, synthetic construct
  source 1..21: mol_type = other RNA
gcaatccagttgaccagagca

SEQ ID NO: 163 - RNA, 21 nt, synthetic construct
  source 1..21: mol_type = other RNA
gcataccagttgaccagagca

SEQ ID NO: 164 - RNA, 21 nt, synthetic construct
  source 1..21: mol_type = other RNA
gctaaccagttgaccagagca

SEQ ID NO: 165 - RNA, 21 nt, synthetic construct
  source 1..21: mol_type = other RNA
tggaaataaagttattactca

SEQ ID NO: 166 - RNA, 21 nt, synthetic construct
  source 1..21: mol_type = other RNA
tggaaataaagttattactca

SEQ ID NO: 167 - RNA, 21 nt, synthetic construct
  source 1..21: mol_type = other RNA
tggaaataaagttattactca

SEQ ID NO: 168 - RNA, 21 nt, synthetic construct
  source 1..21: mol_type = other RNA
tggaaataaagttattactca

SEQ ID NO: 169 - RNA, 21 nt, synthetic construct
  source 1..21: mol_type = other RNA
tggaaataaagttattactca

SEQ ID NO: 170 - RNA, 21 nt, synthetic construct
  source 1..21: mol_type = other RNA
tggaaataaagttattactca

SEQ ID NO: 171 - RNA, 21 nt, synthetic construct
  source 1..21: mol_type = other RNA
tggatataaagttattactca

SEQ ID NO: 172 - RNA, 21 nt, synthetic construct
  source 1..21: mol_type = other RNA
tggtaataaagttattactca

SEQ ID NO: 173 - RNA, 21 nt, synthetic construct
  source 1..21: mol_type = other RNA
tgcaaataaagttattactca

SEQ ID NO: 174 - RNA, 21 nt, synthetic construct
  source 1..21: mol_type = other RNA
cgcatggtcagtaaaagcaaa

SEQ ID NO: 175 - RNA, 21 nt, synthetic construct
  source 1..21: mol_type = other RNA
cgcatggtcagtaaaagcaaa

SEQ ID NO: 176 - RNA, 21 nt, synthetic construct
  source 1..21: mol_type = other RNA
cgcatggtcagtaaaagcaaa

SEQ ID NO: 177 - RNA, 21 nt, synthetic construct
  source 1..21: mol_type = other RNA
cgcatggtcagtaaaagcaaa

SEQ ID NO: 178 - RNA, 21 nt, synthetic construct
  source 1..21: mol_type = other RNA
cgcatggtcagtaaaagcaaa

SEQ ID NO: 179 - RNA, 21 nt, synthetic construct
  source 1..21: mol_type = other RNA
cgcatggtcagtaaaagcaaa

SEQ ID NO: 180 - RNA, 21 nt, synthetic construct
  source 1..21: mol_type = other RNA
cgcatggtcagtaaaagcaaa

SEQ ID NO: 181 - RNA, 19 nt, synthetic construct
  source 1..19: mol_type = other RNA
catggtcagtaaaagcaaa

SEQ ID NO: 182 - RNA, 19 nt, synthetic construct
  source 1..19: mol_type = other RNA
catggtcagtaaaagcaaa

SEQ ID NO: 183 - RNA, 19 nt, synthetic construct
  source 1..19: mol_type = other RNA
catggtcagtaaaagcaaa

SEQ ID NO: 184 - RNA, 21 nt, synthetic construct
  source 1..21: mol_type = other RNA
cgcatggtcagtaaaagcaaa

SEQ ID NO: 185 - RNA, 21 nt, synthetic construct
  source 1..21: mol_type = other RNA
cgcaaggtcagtaaaagcaaa

SEQ ID NO: 186 - RNA, 21 nt, synthetic construct
  source 1..21: mol_type = other RNA
cgcttggtcagtaaaagcaaa

SEQ ID NO: 187 - RNA, 21 nt, synthetic construct
  source 1..21: mol_type = other RNA
cggatggtcagtaaaagcaaa

SEQ ID NO: 188 - RNA, 21 nt, synthetic construct
  source 1..21: mol_type = other RNA
ggtcacgtgacccaagctcga

SEQ ID NO: 189 - RNA, 21 nt, synthetic construct
  source 1..21: mol_type = other RNA
gtcacgtgacccaagctcgca

SEQ ID NO: 190 - RNA, 21 nt, synthetic construct
  source 1..21: mol_type = other RNA
tcacgtgacccaagctcgcaa

SEQ ID NO: 191 - RNA, 21 nt, synthetic construct
  source 1..21: mol_type = other RNA
cacgtgacccaagctcgcata

SEQ ID NO: 192 - RNA, 21 nt, synthetic construct
  source 1..21: mol_type = other RNA
cacgtgacccaagctcgcata

SEQ ID NO: 193 - RNA, 21 nt, synthetic construct
  source 1..21: mol_type = other RNA
acgtgacccaagctcgcatga

SEQ ID NO: 194 - RNA, 21 nt, synthetic construct
  source 1..21: mol_type = other RNA
cgtgacccaagctcgcatgga

SEQ ID NO: 195 - RNA, 21 nt, synthetic construct
  source 1..21: mol_type = other RNA
gtgacccaagctcgcatggta

SEQ ID NO: 196 - RNA, 21 nt, synthetic construct
  source 1..21: mol_type = other RNA
tgacccaagctcgcatggtca

SEQ ID NO: 197 - RNA, 21 nt, synthetic construct
  source 1..21: mol_type = other RNA
gacccaagctcgcatggtcaa

SEQ ID NO: 198 - RNA, 21 nt, synthetic construct
  source 1..21: mol_type = other RNA
acccaagctcgcatggtcaga

SEQ ID NO: 199 - RNA, 21 nt, synthetic construct
  source 1..21: mol_type = other RNA
cccaagctcgcatggtcagta

SEQ ID NO: 200 - RNA, 21 nt, synthetic construct
  source 1..21: mol_type = other RNA
ccaagctcgcatggtcagtaa

SEQ ID NO: 201 - RNA, 21 nt, synthetic construct
  source 1..21: mol_type = other RNA
caagctcgcatggtcagtaaa

SEQ ID NO: 202 - RNA, 21 nt, synthetic construct
  source 1..21: mol_type = other RNA
aagctcgcatggtcagtaaaa

SEQ ID NO: 203 - RNA, 21 nt, synthetic construct
  source 1..21: mol_type = other RNA
agctcgcatggtcagtaaaaa

SEQ ID NO: 204 - RNA, 21 nt, synthetic construct
  source 1..21: mol_type = other RNA
ctcgcatggtcagtaaaagca

SEQ ID NO: 205 - RNA, 21 nt, synthetic construct
  source 1..21: mol_type = other RNA
tcgcatggtcagtaaaagcaa

SEQ ID NO: 206 - RNA, 21 nt, synthetic construct
  source 1..21: mol_type = other RNA
cgcatggtcagtaaaagcaaa

SEQ ID NO: 207 - RNA, 21 nt, synthetic construct
  source 1..21: mol_type = other RNA
gcatggtcagtaaaagcaaaa

SEQ ID NO: 208 - RNA, 21 nt, synthetic construct
  source 1..21: mol_type = other RNA
catggtcagtaaaagcaaaga

SEQ ID NO: 209 - RNA, 21 nt, synthetic construct
  source 1..21: mol_type = other RNA
atggtcagtaaaagcaaagaa

SEQ ID NO: 210 - RNA, 21 nt, synthetic construct
  source 1..21: mol_type = other RNA
tggtcagtaaaagcaaagaca

SEQ ID NO: 211 - RNA, 21 nt, synthetic construct
  source 1..21: mol_type = other RNA
ggtcagtaaaagcaaagacga

SEQ ID NO: 212 - RNA, 21 nt, synthetic construct
  source 1..21: mol_type = other RNA
gtcagtaaaagcaaagacgga

SEQ ID NO: 213 - RNA, 21 nt, synthetic construct
  source 1..21: mol_type = other RNA
agtaaaagcaaagacgggaca

SEQ ID NO: 214 - RNA, 21 nt, synthetic construct
  source 1..21: mol_type = other RNA
agtaaaagcaaagacgggaca

SEQ ID NO: 215 - RNA, 21 nt, synthetic construct
  source 1..21: mol_type = other RNA
gtgtgcaaatagtctacaaaa

SEQ ID NO: 216 - RNA, 21 nt, synthetic construct
  source 1..21: mol_type = other RNA
tgtgcaaatagtctacaaaca

SEQ ID NO: 217 - RNA, 21 nt, synthetic construct
  source 1..21: mol_type = other RNA
gtgcaaatagtctacaaacca

SEQ ID NO: 218 - RNA, 21 nt, synthetic construct
  source 1..21: mol_type = other RNA
tgcaaatagtctacaaaccaa

SEQ ID NO: 219 - RNA, 21 nt, synthetic construct
  source 1..21: mol_type = other RNA
gcaaatagtctacaaaccaga

SEQ ID NO: 220 - RNA, 21 nt, synthetic construct
  source 1..21: mol_type = other RNA
caaatagtctacaaaccagta

SEQ ID NO: 221 - RNA, 21 nt, synthetic construct
  source 1..21: mol_type = other RNA
aatagtctacaaaccagttga

SEQ ID NO: 222 - RNA, 21 nt, synthetic construct
  source 1..21: mol_type = other RNA
atagtctacaaaccagttgaa

SEQ ID NO: 223 - RNA, 21 nt, synthetic construct
  source 1..21: mol_type = other RNA
tagtctacaaaccagttgaca

SEQ ID NO: 224 - RNA, 21 nt, synthetic construct
  source 1..21: mol_type = other RNA
agtctacaaaccagttgacca

SEQ ID NO: 225 - RNA, 21 nt, synthetic construct
  source 1..21: mol_type = other RNA
gtctacaaaccagttgaccta

SEQ ID NO: 226 - RNA, 21 nt, synthetic construct
  source 1..21: mol_type = other RNA
tctacaaaccagttgacctga

SEQ ID NO: 227 - RNA, 21 nt, synthetic construct
  source 1..21: mol_type = other RNA
ctacaaaccagttgacctgaa

SEQ ID NO: 228 - RNA, 21 nt, synthetic construct
  source 1..21: mol_type = other RNA
tacaaaccagttgacctgaga

SEQ ID NO: 229 - RNA, 21 nt, synthetic construct
  source 1..21: mol_type = other RNA
acaaaccagttgacctgagca

SEQ ID NO: 230 - RNA, 21 nt, synthetic construct
  source 1..21: mol_type = other RNA
caaaccagttgacctgagcaa

SEQ ID NO: 231 - RNA, 21 nt, synthetic construct
  source 1..21: mol_type = other RNA
aaaccagttgacctgagcaaa

SEQ ID NO: 232 - RNA, 21 nt, synthetic construct
  source 1..21: mol_type = other RNA
aaccagttgacctgagcaaga

SEQ ID NO: 233 - RNA, 21 nt, synthetic construct
  source 1..21: mol_type = other RNA
accagttgacctgagcaagga

SEQ ID NO: 234 - RNA, 21 nt, synthetic construct
  source 1..21: mol_type = other RNA
ccagttgacctgagcaaggta

SEQ ID NO: 235 - RNA, 21 nt, synthetic construct
  source 1..21: mol_type = other RNA
cagttgacctgagcaaggtga

SEQ ID NO: 236 - RNA, 21 nt, synthetic construct
  source 1..21: mol_type = other RNA
agtaaaatctgagaagcttga

SEQ ID NO: 237 - RNA, 21 nt, synthetic construct
  source 1..21: mol_type = other RNA
gtaaaatctgagaagcttgaa

SEQ ID NO: 238 - RNA, 21 nt, synthetic construct
  source 1..21: mol_type = other RNA
taaaatctgagaagcttgaca

SEQ ID NO: 239 - RNA, 21 nt, synthetic construct
  source 1..21: mol_type = other RNA
aaaatctgagaagcttgacta

SEQ ID NO: 240 - RNA, 21 nt, synthetic construct
  source 1..21: mol_type = other RNA
aaatctgagaagcttgactta

SEQ ID NO: 241 - RNA, 21 nt, synthetic construct
  source 1..21: mol_type = other RNA
aatctgagaagcttgacttca

SEQ ID NO: 242 - RNA, 21 nt, synthetic construct
  source 1..21: mol_type = other RNA
atctgagaagcttgacttcaa

SEQ ID NO: 243 - RNA, 21 nt, synthetic construct
  source 1..21: mol_type = other RNA
tctgagaagcttgacttcaaa

SEQ ID NO: 244 - RNA, 21 nt, synthetic construct
  source 1..21: mol_type = other RNA
ctgagaagcttgacttcaaga

SEQ ID NO: 245 - RNA, 21 nt, synthetic construct
  source 1..21: mol_type = other RNA
tgagaagcttgacttcaagga

SEQ ID NO: 246 - RNA, 21 nt, synthetic construct
  source 1..21: mol_type = other RNA
gagaagcttgacttcaaggaa

SEQ ID NO: 247 - RNA, 21 nt, synthetic construct
  source 1..21: mol_type = other RNA
agaagcttgacttcaaggaca

SEQ ID NO: 248 - RNA, 21 nt, synthetic construct
  source 1..21: mol_type = other RNA
gaagcttgacttcaaggacaa

SEQ ID NO: 249 - RNA, 21 nt, synthetic construct
  source 1..21: mol_type = other RNA
tttggaaataaagttattaca

SEQ ID NO: 250 - RNA, 21 nt, synthetic construct
  source 1..21: mol_type = other RNA
ttggaaataaagttattacta

SEQ ID NO: 251 - RNA, 21 nt, synthetic construct
  source 1..21: mol_type = other RNA
ttggaaataaagttattacta

SEQ ID NO: 252 - RNA, 21 nt, synthetic construct
  source 1..21: mol_type = other RNA
tggaaataaagttattactca

SEQ ID NO: 253 - RNA, 21 nt, synthetic construct
  source 1..21: mol_type = other RNA
gaaataaagttattactctga

SEQ ID NO: 254 - RNA, 21 nt, synthetic construct
  source 1..21: mol_type = other RNA
aaataaagttattactctgaa

SEQ ID NO: 255 - RNA, 21 nt, synthetic construct
  source 1..21: mol_type = other RNA
aataaagttattactctgata

SEQ ID NO: 256 - RNA, 21 nt, synthetic construct
  source 1..21: mol_type = other RNA
ataaagttattactctgatta

SEQ ID NO: 257 - RNA, 21 nt, synthetic construct
  source 1..21: mol_type = other RNA
tggaaataaagttattactca

SEQ ID NO: 258 - RNA, 21 nt, synthetic construct
  source 1..21: mol_type = other RNA
cgcatggtcagtaaaagcaaa

SEQ ID NO: 259 - RNA, 23 nt, synthetic construct
  source 1..23: mol_type = other RNA
  modified_base 12: mod_base = OTHER; note = 5'-methyluridine-3'-phosphate
tcatgcgagcttgggtcacgtga

SEQ ID NO: 260 - RNA, 23 nt, synthetic construct
  source 1..23: mol_type = other RNA
taccatgcgagcttgggtcacgt

SEQ ID NO: 261 - RNA, 23 nt, synthetic construct
  source 1..23: mol_type = other RNA
  modified_base 7: mod_base = OTHER; note = 5'-methyluridine-3'-phosphate
tgaccatgcgagcttgggtcacg

SEQ ID NO: 262 - RNA, 23 nt, synthetic construct
  source 1..23: mol_type = other RNA
tctgaccatgcgagcttgggtca

SEQ ID NO: 263 - RNA, 23 nt, synthetic construct
  source 1..23: mol_type = other RNA
  modified_base 7: mod_base = OTHER; note = 5'-methyluridine-3'-phosphate
ttcaactggtttgtagactattt

SEQ ID NO: 264 - RNA, 23 nt, synthetic construct
  source 1..23: mol_type = other RNA
  modified_base 5: mod_base = OTHER; note = 5'-methyluridine-3'-phosphate
taggtcaactggtttgtagacta

SEQ ID NO: 265 - RNA, 23 nt, synthetic construct
  source 1..23: mol_type = other RNA
  modified_base 7: mod_base = OTHER; note = 5'-methyluridine-3'-phosphate
ttgaagtcaagcttctcagattt

SEQ ID NO: 266 - RNA, 23 nt, synthetic construct
  source 1..23: mol_type = other RNA
  modified_base 7: mod_base = OTHER; note = 5'-methyluridine-3'-phosphate
tcagagtaataactttatttcca

SEQ ID NO: 267 - RNA, 23 nt, synthetic construct
  source 1..23: mol_type = other RNA
  modified_base 5: mod_base = OTHER; note = 5'-methyluridine-3'-phosphate
tcttttactgaccatgcgagctt

SEQ ID NO: 268 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
tgcttttactgaccatgcgagct

SEQ ID NO: 269 - RNA, 23 nt, synthetic construct
  source 1..23: mol_type = other RNA
  modified_base 5: mod_base = OTHER; note = 5'-methyluridine-3'-phosphate
ttctttgcttttactgaccatgc

SEQ ID NO: 270 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
tccgtctttgcttttactgacca

SEQ ID NO: 271 - RNA, 23 nt, synthetic construct
  source 1..23: mol_type = other RNA
tcccgtctttgcttttactgacc

SEQ ID NO: 272 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
ttcccgtctttgcttttactgac

SEQ ID NO: 273 - RNA, 23 nt, synthetic construct
  source 1..23: mol_type = other RNA
  modified_base 7: mod_base = OTHER; note = 5'-methyluridine-3'-phosphate
tctggtttgtagactatttgcac

SEQ ID NO: 274 - RNA, 23 nt, synthetic construct
  source 1..23: mol_type = other RNA
  modified_base 5: mod_base = OTHER; note = 5'-methyluridine-3'-phosphate
taactggtttgtagactatttgc

SEQ ID NO: 275 - RNA, 23 nt, synthetic construct
  source 1..23: mol_type = other RNA
tcaactggtttgtagactatttg

SEQ ID NO: 276 - RNA, 23 nt, synthetic construct
  source 1..23: mol_type = other RNA
  modified_base 12: mod_base = OTHER; note = 5'-methyluridine-3'-phosphate
tgtcaactggtttgtagactatt

SEQ ID NO: 277 - RNA, 23 nt, synthetic construct
  source 1..23: mol_type = other RNA
tctcaggtcaactggtttgtaga

SEQ ID NO: 278 - RNA, 23 nt, synthetic construct
  source 1..23: mol_type = other RNA
tgctcaggtcaactggtttgtag

SEQ ID NO: 279 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
ttaactttatttccaaattcact

SEQ ID NO: 280 - RNA, 23 nt, synthetic construct
  source 1..23: mol_type = other RNA
  modified_base 7: mod_base = OTHER; note = 5'-methyluridine-3'-phosphate
ttaactttatttccaaattcact

SEQ ID NO: 281 - RNA, 23 nt, synthetic construct
  source 1..23: mol_type = other RNA
  modified_base 7: mod_base = OTHER; note = 5'-methyluridine-3'-phosphate
tataactttatttccaaattcac

SEQ ID NO: 282 - RNA, 23 nt, synthetic construct
  source 1..23: mol_type = other RNA
  modified_base 12: mod_base = OTHER; note = 5'-methyluridine-3'-phosphate
taataactttatttccaaattca

SEQ ID NO: 283 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
ttaataactttatttccaaattc

SEQ ID NO: 284 - RNA, 23 nt, synthetic construct
  source 1..23: mol_type = other RNA
  modified_base 5: mod_base = OTHER; note = 5'-methyluridine-3'-phosphate
ttaataactttatttccaaattc

SEQ ID NO: 285 - RNA, 23 nt, synthetic construct
  source 1..23: mol_type = other RNA
tagagtaataactttatttccaa

SEQ ID NO: 286 - RNA, 23 nt, synthetic construct
  source 1..23: mol_type = other RNA
  modified_base 5: mod_base = OTHER; note = 5'-methyluridine-3'-phosphate
ttaatcagagtaataactttatt

SEQ ID NO: 287 - RNA, 23 nt, synthetic construct
  source 1..23: mol_type = other RNA
taccatgcgagcttgggtcacgt

SEQ ID NO: 288 - RNA, 23 nt, synthetic construct
  source 1..23: mol_type = other RNA
taccatgcgagcttgggtcacgt

SEQ ID NO: 289 - RNA, 23 nt, synthetic construct
  source 1..23: mol_type = other RNA
taccatgcgagcttgggtcacgt

SEQ ID NO: 290 - RNA, 23 nt, synthetic construct
  source 1..23: mol_type = other RNA
taccatgcgagcttgggtcacgt

SEQ ID NO: 291 - RNA, 23 nt, synthetic construct
  source 1..23: mol_type = other RNA
taccatgcgagcttgggtcacgt

SEQ ID NO: 292 - RNA, 23 nt, synthetic construct
  source 1..23: mol_type = other RNA
taccatgcgagcttgggtcacgt

SEQ ID NO: 293 - RNA, 23 nt, synthetic construct
  source 1..23: mol_type = other RNA
taccatgcgagcttggctcacgt

SEQ ID NO: 294 - RNA, 23 nt, synthetic construct
  source 1..23: mol_type = other RNA
taccatgcgagcttggttcacgt

SEQ ID NO: 295 - RNA, 23 nt, synthetic construct
  source 1..23: mol_type = other RNA
taccatgcgagcttgggacacgt

SEQ ID NO: 296 - RNA, 23 nt, synthetic construct
  source 1..23: mol_type = other RNA
taccatgcgagcttgggtgacgt

SEQ ID NO: 297 - RNA, 23 nt, synthetic construct
  source 1..23: mol_type = other RNA
taccatgcgagcttgggtaacgt

SEQ ID NO: 298 - RNA, 23 nt, synthetic construct
  source 1..23: mol_type = other RNA
  modified_base 6: mod_base = OTHER; note = 5'-methyluridine-3'-phosphate
taccatgcgagcttgggtcacgt

SEQ ID NO: 299 - RNA, 23 nt, synthetic construct
  source 1..23: mol_type = other RNA
  modified_base 6: mod_base = OTHER; note = 5'-methyluridine-3'-phosphate
taccatgcgagcttgggtcacgt

SEQ ID NO: 300 - RNA, 23 nt, synthetic construct
  source 1..23: mol_type = other RNA
  modified_base 6: mod_base = OTHER; note = 5'-methyluridine-3'-phosphate
taccatgcgagcttgggtcacgt

SEQ ID NO: 301 - RNA, 23 nt, synthetic construct
  source 1..23: mol_type = other RNA
  modified_base 6: mod_base = OTHER; note = 5'-methyluridine-3'-phosphate
taccatgcgagcttgggtcacgt

SEQ ID NO: 302 - RNA, 23 nt, synthetic construct
  source 1..23: mol_type = other RNA
taccatgcgagcttgggtcacgt

SEQ ID NO: 303 - RNA, 23 nt, synthetic construct
  source 1..23: mol_type = other RNA
taccaagcgagcttgggtcacgt

SEQ ID NO: 304 - RNA, 23 nt, synthetic construct
  source 1..23: mol_type = other RNA
taccatacgagcttgggtcacgt

SEQ ID NO: 305 - RNA, 23 nt, synthetic construct
  source 1..23: mol_type = other RNA
taccatgcgagcttgggtcacgt

SEQ ID NO: 306 - RNA, 23 nt, synthetic construct
  source 1..23: mol_type = other RNA
taccaagcgagcttgggtcacgt

SEQ ID NO: 307 - RNA, 23 nt, synthetic construct
  source 1..23: mol_type = other RNA
taccatacgagcttgggtcacgt

SEQ ID NO: 308 - RNA, 23 nt, synthetic construct
  source 1..23: mol_type = other RNA
tctcaggtcaactggtttgtagg

SEQ ID NO: 309 - RNA, 23 nt, synthetic construct
  source 1..23: mol_type = other RNA
  modified_base 16: mod_base = OTHER; note = 5'-methyluridine-3'-phosphate
tctcaggtcaactggtttgtagg

SEQ ID NO: 310 - RNA, 23 nt, synthetic construct
  source 1..23: mol_type = other RNA
  modified_base 16: mod_base = OTHER; note = 5'-methyluridine-3'-phosphate
tctcaggtcaactggtttgtagg

SEQ ID NO: 311 - RNA, 23 nt, synthetic construct
  source 1..23: mol_type = other RNA
  modified_base 16: mod_base = OTHER; note = 5'-methyluridine-3'-phosphate
tctcaggtcaactggtttgtagg

SEQ ID NO: 312 - RNA, 23 nt, synthetic construct
  source 1..23: mol_type = other RNA
tctcaggtcaactggtttgtaga

SEQ ID NO: 313 - RNA, 23 nt, synthetic construct
  source 1..23: mol_type = other RNA
  modified_base 8: mod_base = OTHER; note = 5'-methyluridine-3'-phosphate
tctcaggtcaactggtttgtagg

SEQ ID NO: 314 - RNA, 23 nt, synthetic construct
  source 1..23: mol_type = other RNA
  modified_base 8: mod_base = OTHER; note = 5'-methyluridine-3'-phosphate
  modified_base 16: mod_base = OTHER; note = 5'-methyluridine-3'-phosphate
tctcaggtcaactggtttgtagg

SEQ ID NO: 315 - RNA, 23 nt, synthetic construct
  source 1..23: mol_type = other RNA
  modified_base 8: mod_base = OTHER; note = 5'-methyluridine-3'-phosphate
  modified_base 16: mod_base = OTHER; note = 5'-methyluridine-3'-phosphate
tctcaggtcaactggtttgtagg

SEQ ID NO: 316 - RNA, 23 nt, synthetic construct
  source 1..23: mol_type = other RNA
tctcaggtcaactggtttgtagg

SEQ ID NO: 317 - RNA, 23 nt, synthetic construct
  source 1..23: mol_type = other RNA
tctcacgtcaactggtttgtagg

SEQ ID NO: 318 - RNA, 23 nt, synthetic construct
  source 1..23: mol_type = other RNA
tctcaagtcaactggtttgtagg

SEQ ID NO: 319 - RNA, 23 nt, synthetic construct
  source 1..23: mol_type = other RNA
tctcagatcaactggtttgtagg

SEQ ID NO: 320 - RNA, 23 nt, synthetic construct
  source 1..23: mol_type = other RNA
tctcacgtcaactggtttgtagg

SEQ ID NO: 321 - RNA, 23 nt, synthetic construct
  source 1..23: mol_type = other RNA
tctcaagtcaactggtttgtagg

SEQ ID NO: 322 - RNA, 23 nt, synthetic construct
  source 1..23: mol_type = other RNA
tctcagatcaactggtttgtagg

SEQ ID NO: 323 - RNA, 21 nt, synthetic construct
  source 1..21: mol_type = other RNA
tctcaggtcaactggtttgtg

SEQ ID NO: 324 - RNA, 21 nt, synthetic construct
  source 1..21: mol_type = other RNA
tctcaggtcaactggtttgtg

SEQ ID NO: 325 - RNA, 23 nt, synthetic construct
  source 1..23: mol_type = other RNA
  modified_base 5: mod_base = OTHER; note = 5'-methyluridine-3'-phosphate
taggtcaactggtttgtagactg

SEQ ID NO: 326 - RNA, 23 nt, synthetic construct
  source 1..23: mol_type = other RNA
taggtcaactggtttgtagactg

SEQ ID NO: 327 - RNA, 23 nt, synthetic construct
  source 1..23: mol_type = other RNA
  modified_base 5: mod_base = OTHER; note = 5'-methyluridine-3'-phosphate
taggtcaactggtttgaagactg

SEQ ID NO: 328 - RNA, 23 nt, synthetic construct
  source 1..23: mol_type = other RNA
  modified_base 5: mod_base = OTHER; note = 5'-methyluridine-3'-phosphate
taggtcaactggtttgttgactg

SEQ ID NO: 329 - RNA, 23 nt, synthetic construct
  source 1..23: mol_type = other RNA
  modified_base 5: mod_base = OTHER; note = 5'-methyluridine-3'-phosphate
taggtcaactggtttgtacactg

SEQ ID NO: 330 - RNA, 23 nt, synthetic construct
  source 1..23: mol_type = other RNA
  modified_base 5: mod_base = OTHER; note = 5'-methyluridine-3'-phosphate
taggtcaactggtttgtagactg

SEQ ID NO: 331 - RNA, 23 nt, synthetic construct
  source 1..23: mol_type = other RNA
  modified_base 5: mod_base = OTHER; note = 5'-methyluridine-3'-phosphate
taggtcaactggtttgtagactg

SEQ ID NO: 332 - RNA, 23 nt, synthetic construct
  source 1..23: mol_type = other RNA
  modified_base 5: mod_base = OTHER; note = 5'-methyluridine-3'-phosphate
taggtaaactggtttgtagactg

SEQ ID NO: 333 - RNA, 23 nt, synthetic construct
  source 1..23: mol_type = other RNA
  modified_base 5: mod_base = OTHER; note = 5'-methyluridine-3'-phosphate
taggtaaactggtttgtagactg

SEQ ID NO: 334 - RNA, 23 nt, synthetic construct
  source 1..23: mol_type = other RNA
  modified_base 7: mod_base = OTHER; note = 5'-methyluridine-3'-phosphate
ttcaactggtttgtagactattt

SEQ ID NO: 335 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
ttcaactggtttgtagactattt

SEQ ID NO: 336 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
ttcaactggtttgtagactattt

SEQ ID NO: 337 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
ttcaactggtttgtagactattt

SEQ ID NO: 338 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
ttcaactggtttgtagactatct

SEQ ID NO: 339 - RNA, 22 nt, synthetic construct
  source 1..22: mol_type = other RNA
  modified_base 7: mod_base = OTHER; note = 5'-methyluridine-3'-phosphate
  modified_base 12: mod_base = OTHER; note = 5'-methyluridine-3'-phosphate
ttcaactggtttgtagactatc

SEQ ID NO: 340 - RNA, 21 nt, synthetic construct
  source 1..21: mol_type = other RNA
  modified_base 7: mod_base = OTHER; note = 5'-methyluridine-3'-phosphate
  modified_base 12: mod_base = OTHER; note = 5'-methyluridine-3'-phosphate
ttcaactggtttgtagactgt

SEQ ID NO: 341 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
ttcaactggtttgtagtctatct

SEQ ID NO: 342 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
ttcaactggtttgtagagtatct

SEQ ID NO: 343 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
ttcaactggtttgtagacaatct

SEQ ID NO: 344 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
ttcaattggtttgtagactatct

SEQ ID NO: 345 - RNA, 23 nt, synthetic construct
  source 1..23: mol_type = other RNA
  modified_base 2: mod_base = OTHER; note = 5'-methyluridine-3'-phosphate
  modified_base 12: mod_base = OTHER; note = 5'-methyluridine-3'-phosphate
ttcaacaggtttgtagactatct

SEQ ID NO: 346 - RNA, 23 nt, synthetic construct
  source 1..23: mol_type = other RNA
  modified_base 2: mod_base = OTHER; note = 5'-methyluridine-3'-phosphate
  modified_base 12: mod_base = OTHER; note = 5'-methyluridine-3'-phosphate
ttcaacgggtttgtagactatct

SEQ ID NO: 347 - RNA, 23 nt, synthetic construct
  source 1..23: mol_type = other RNA
  modified_base 2: mod_base = OTHER; note = 5'-methyluridine-3'-phosphate
  modified_base 12: mod_base = OTHER; note = 5'-methyluridine-3'-phosphate
ttcaaccggtttgtagactatct

SEQ ID NO: 348 - RNA, 23 nt, synthetic construct
  source 1..23: mol_type = other RNA
  modified_base 5: mod_base = OTHER; note = 5'-methyluridine-3'-phosphate
taactggtttgtagactatttgc

SEQ ID NO: 349 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
taactggtttgtagactatttgc

SEQ ID NO: 350 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
taactggtttgtagactatttgc

SEQ ID NO: 351 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
taactggtttgtagactatttct

SEQ ID NO: 352 - RNA, 23 nt, synthetic construct
  source 1..23: mol_type = other RNA
  modified_base 5: mod_base = OTHER; note = 5'-methyluridine-3'-phosphate
taactggtttgtagacaatttgc

SEQ ID NO: 353 - RNA, 23 nt, synthetic construct
  source 1..23: mol_type = other RNA
  modified_base 5: mod_base = OTHER; note = 5'-methyluridine-3'-phosphate
taactggtttgtagactttttgc

SEQ ID NO: 354 - RNA, 23 nt, synthetic construct
  source 1..23: mol_type = other RNA
  modified_base 5: mod_base = OTHER; note = 5'-methyluridine-3'-phosphate
taactggtttgtagactaattgc

SEQ ID NO: 355 - RNA, 23 nt, synthetic construct
  source 1..23: mol_type = other RNA
  modified_base 8: mod_base = OTHER; note = 5'-methyluridine-3'-phosphate
taactggtttgtagactatttgc

SEQ ID NO: 356 - RNA, 23 nt, synthetic construct
  source 1..23: mol_type = other RNA
  modified_base 8: mod_base = OTHER; note = 5'-methyluridine-3'-phosphate
  modified_base 12: mod_base = OTHER; note = 5'-methyluridine-3'-phosphate
taactggtttgtagactatttgc

SEQ ID NO: 357 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
taactcgtttgtagactatttgc

SEQ ID NO: 358 - RNA, 23 nt, synthetic construct
  source 1..23: mol_type = other RNA
  modified_base 5: mod_base = OTHER; note = 5'-methyluridine-3'-phosphate
tcttttactgaccatgcgagctt

SEQ ID NO: 359 - RNA, 23 nt, synthetic construct
  source 1..23: mol_type = other RNA
  modified_base 5: mod_base = OTHER; note = 5'-methyluridine-3'-phosphate
tcttttactgaccatgcgagctt

SEQ ID NO: 360 - RNA, 23 nt, synthetic construct
  source 1..23: mol_type = other RNA
  modified_base 5: mod_base = OTHER; note = 5'-methyluridine-3'-phosphate
tcttttactgaccatgcgagctt

SEQ ID NO: 361 - RNA, 23 nt, synthetic construct
  source 1..23: mol_type = other RNA
  modified_base 5: mod_base = OTHER; note = 5'-methyluridine-3'-phosphate
tcttttactgaccatgggagctt

SEQ ID NO: 362 - RNA, 23 nt, synthetic construct
  source 1..23: mol_type = other RNA
  modified_base 5: mod_base = OTHER; note = 5'-methyluridine-3'-phosphate
tcttttactgaccatgccagctt

SEQ ID NO: 363 - RNA, 23 nt, synthetic construct
  source 1..23: mol_type = other RNA
  modified_base 5: mod_base = OTHER; note = 5'-methyluridine-3'-phosphate
tcttttactgaccatgcgtgctt

SEQ ID NO: 364 - RNA, 23 nt, synthetic construct
  source 1..23: mol_type = other RNA
  modified_base 5: mod_base = OTHER; note = 5'-methyluridine-3'-phosphate
tcttttaatgaccatgcgagctt

SEQ ID NO: 365 - RNA, 23 nt, synthetic construct
  source 1..23: mol_type = other RNA
  modified_base 5: mod_base = OTHER; note = 5'-methyluridine-3'-phosphate
tctttaactgaccatgcgagctt

SEQ ID NO: 366 - RNA, 23 nt, synthetic construct
  source 1..23: mol_type = other RNA
  modified_base 5: mod_base = OTHER; note = 5'-methyluridine-3'-phosphate
tcttttaatgaccatgggagctt

SEQ ID NO: 367 - RNA, 23 nt, synthetic construct
  source 1..23: mol_type = other RNA
  modified_base 5: mod_base = OTHER; note = 5'-methyluridine-3'-phosphate
tctttaactgaccatgggagctt

SEQ ID NO: 368 - RNA, 23 nt, synthetic construct
  source 1..23: mol_type = other RNA
  modified_base 5: mod_base = OTHER; note = 5'-methyluridine-3'-phosphate
tcttttaatgaccatgccagctt

SEQ ID NO: 369 - RNA, 23 nt, synthetic construct
  source 1..23: mol_type = other RNA
  modified_base 5: mod_base = OTHER; note = 5'-methyluridine-3'-phosphate
tctttaactgaccatgccagctt

SEQ ID NO: 370 - RNA, 23 nt, synthetic construct
  source 1..23: mol_type = other RNA
  modified_base 5: mod_base = OTHER; note = 5'-methyluridine-3'-phosphate
tcttttaatgaccatgcgtgctt

SEQ ID NO: 371 - RNA, 23 nt, synthetic construct
  source 1..23: mol_type = other RNA
  modified_base 5: mod_base = OTHER; note = 5'-methyluridine-3'-phosphate
tctttaactgaccatgcgtgctt

SEQ ID NO: 372 - RNA, 23 nt, synthetic construct
  source 1..23: mol_type = other RNA
ttgaagtcaagcttctcagattt

SEQ ID NO: 373 - RNA, 23 nt, synthetic construct
  source 1..23: mol_type = other RNA
  modified_base 7: mod_base = OTHER; note = 5'-methyluridine-3'-phosphate
ttgaagtcaagcttctcagattt

SEQ ID NO: 374 - RNA, 23 nt, synthetic construct
  source 1..23: mol_type = other RNA
  modified_base 7: mod_base = OTHER; note = 5'-methyluridine-3'-phosphate
  modified_base 16: mod_base = OTHER; note = 5'-methyluridine-3'-phosphate
ttgaagtcaagcttctcagattt

SEQ ID NO: 375 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 16: mod_base = OTHER; note = 5'-methyluridine-3'-phosphate
ttgaagtcaagcttctcagattt

SEQ ID NO: 376 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 14: mod_base = OTHER; note = 5'-methyluridine-3'-phosphate
  modified_base 16: mod_base = OTHER; note = 5'-methyluridine-3'-phosphate
ttgaagtcaagcttctcagattt

SEQ ID NO: 377 - RNA, 23 nt, synthetic construct
  source 1..23: mol_type = other RNA
  modified_base 7: mod_base = OTHER; note = 5'-methyluridine-3'-phosphate
ttgaagtcaagcttctgagattt

SEQ ID NO: 378 - RNA, 23 nt, synthetic construct
  source 1..23: mol_type = other RNA
  modified_base 7: mod_base = OTHER; note = 5'-methyluridine-3'-phosphate
ttgaagtcaagcttctaagattt

SEQ ID NO: 379 - RNA, 23 nt, synthetic construct
  source 1..23: mol_type = other RNA
  modified_base 7: mod_base = OTHER; note = 5'-methyluridine-3'-phosphate
ttgaagtcaagcttctctgattt

SEQ ID NO: 380 - RNA, 23 nt, synthetic construct
  source 1..23: mol_type = other RNA
  modified_base 7: mod_base = OTHER; note = 5'-methyluridine-3'-phosphate
ttgaagtcaagcttctcacattt

SEQ ID NO: 381 - RNA, 23 nt, synthetic construct
  source 1..23: mol_type = other RNA
  modified_base 7: mod_base = OTHER; note = 5'-methyluridine-3'-phosphate
ttgaagtcaagcttctcatattt

SEQ ID NO: 382 - RNA, 23 nt, synthetic construct
  source 1..23: mol_type = other RNA
  modified_base 7: mod_base = OTHER; note = 5'-methyluridine-3'-phosphate
ttgaaatcaagcttctcagattt

SEQ ID NO: 383 - RNA, 21 nt, synthetic construct
  source 1..21: mol_type = other RNA
  modified_base 7: mod_base = OTHER; note = 5'-methyluridine-3'-phosphate
ttgaagtcaagcttctcaggt

SEQ ID NO: 384 - RNA, 21 nt, synthetic construct
  source 1..21: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 16: mod_base = OTHER; note = 5'-methyluridine-3'-phosphate
ttgaagtcaagcttctcaggt

SEQ ID NO: 385 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
ttctttgcttttactgaccatgc

SEQ ID NO: 386 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
ttctttgcttttactgaccatgc

SEQ ID NO: 387 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 12: mod_base = OTHER; note = 5'-methyluridine-3'-phosphate
ttctttgcttttactgaccatgc

SEQ ID NO: 388 - RNA, 23 nt, synthetic construct
  source 1..23: mol_type = other RNA
  modified_base 5: mod_base = OTHER; note = 5'-methyluridine-3'-phosphate
tggtttgtagactatttgcacac

SEQ ID NO: 389 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
ttggtttgtagactatttgcaca

SEQ ID NO: 390 - RNA, 23 nt, synthetic construct
  source 1..23: mol_type = other RNA
  modified_base 7: mod_base = OTHER; note = 5'-methyluridine-3'-phosphate
tctggtttgtagactatttgcac

SEQ ID NO: 391 - RNA, 23 nt, synthetic construct
  source 1..23: mol_type = other RNA
  modified_base 7: mod_base = OTHER; note = 5'-methyluridine-3'-phosphate
tactggtttgtagactatttgca

SEQ ID NO: 392 - RNA, 23 nt, synthetic construct
  source 1..23: mol_type = other RNA
tcaactggtttgtagactatttg

SEQ ID NO: 393 - RNA, 23 nt, synthetic construct
  source 1..23: mol_type = other RNA
  modified_base 7: mod_base = OTHER; note = 5'-methyluridine-3'-phosphate
ttcaactggtttgtagactattt

SEQ ID NO: 394 - RNA, 23 nt, synthetic construct
  source 1..23: mol_type = other RNA
tgtcaactggtttgtagactatt

SEQ ID NO: 395 - RNA, 23 nt, synthetic construct
  source 1..23: mol_type = other RNA
tggtcaactggtttgtagactat

SEQ ID NO: 396 - RNA, 23 nt, synthetic construct
  source 1..23: mol_type = other RNA
  modified_base 5: mod_base = OTHER; note = 5'-methyluridine-3'-phosphate
taggtcaactggtttgtagacta

SEQ ID NO: 397 - RNA, 23 nt, synthetic construct
  source 1..23: mol_type = other RNA
tcaggtcaactggtttgtagact

SEQ ID NO: 398 - RNA, 23 nt, synthetic construct
  source 1..23: mol_type = other RNA
  modified_base 7: mod_base = OTHER; note = 5'-methyluridine-3'-phosphate
ttcaggtcaactggtttgtagac

SEQ ID NO: 399 - RNA, 23 nt, synthetic construct
  source 1..23: mol_type = other RNA
tctcaggtcaactggtttgtaga

SEQ ID NO: 400 - RNA, 23 nt, synthetic construct
  source 1..23: mol_type = other RNA
tgctcaggtcaactggtttgtag

SEQ ID NO: 401 - RNA, 23 nt, synthetic construct
  source 1..23: mol_type = other RNA
  modified_base 5: mod_base = OTHER; note = 5'-methyluridine-3'-phosphate
ttgctcaggtcaactggtttgta

SEQ ID NO: 402 - RNA, 23 nt, synthetic construct
  source 1..23: mol_type = other RNA
tttgctcaggtcaactggtttgt

SEQ ID NO: 403 - RNA, 23 nt, synthetic construct
  source 1..23: mol_type = other RNA
  modified_base 7: mod_base = OTHER; note = 5'-methyluridine-3'-phosphate
tcttgctcaggtcaactggtttg

SEQ ID NO: 404 - RNA, 23 nt, synthetic construct
  source 1..23: mol_type = other RNA
  modified_base 5: mod_base = OTHER; note = 5'-methyluridine-3'-phosphate
tccttgctcaggtcaactggttt

SEQ ID NO: 405 - RNA, 23 nt, synthetic construct
  source 1..23: mol_type = other RNA
  modified_base 5: mod_base = OTHER; note = 5'-methyluridine-3'-phosphate
taccttgctcaggtcaactggtt

SEQ ID NO: 406 - RNA, 23 nt, synthetic construct
  source 1..23: mol_type = other RNA
  modified_base 7: mod_base = OTHER; note = 5'-methyluridine-3'-phosphate
tcaccttgctcaggtcaactggt

SEQ ID NO: 407 - RNA, 23 nt, synthetic construct
  source 1..23: mol_type = other RNA
  modified_base 7: mod_base = OTHER; note = 5'-methyluridine-3'-phosphate
tcaagcttctcagattttacttc

SEQ ID NO: 408 - RNA, 23 nt, synthetic construct
  source 1..23: mol_type = other RNA
ttcaagcttctcagattttactt

SEQ ID NO: 409 - RNA, 23 nt, synthetic construct
  source 1..23: mol_type = other RNA
tgtcaagcttctcagattttact

SEQ ID NO: 410 - RNA, 23 nt, synthetic construct
  source 1..23: mol_type = other RNA
tagtcaagcttctcagattttac

SEQ ID NO: 411 - RNA, 23 nt, synthetic construct
  source 1..23: mol_type = other RNA
  modified_base 5: mod_base = OTHER; note = 5'-methyluridine-3'-phosphate
taagtcaagcttctcagatttta

SEQ ID NO: 412 - RNA, 23 nt, synthetic construct
  source 1..23: mol_type = other RNA
tgaagtcaagcttctcagatttt

SEQ ID NO: 413 - RNA, 23 nt, synthetic construct
  source 1..23: mol_type = other RNA
  modified_base 7: mod_base = OTHER; note = 5'-methyluridine-3'-phosphate
ttgaagtcaagcttctcagattt

SEQ ID NO: 414 - RNA, 23 nt, synthetic construct
  source 1..23: mol_type = other RNA
tttgaagtcaagcttctcagatt

SEQ ID NO: 415 - RNA, 23 nt, synthetic construct
  source 1..23: mol_type = other RNA
tcttgaagtcaagcttctcagat

SEQ ID NO: 416 - RNA, 23 nt, synthetic construct
  source 1..23: mol_type = other RNA
  modified_base 5: mod_base = OTHER; note = 5'-methyluridine-3'-phosphate
tccttgaagtcaagcttctcaga

SEQ ID NO: 417 - RNA, 23 nt, synthetic construct
  source 1..23: mol_type = other RNA
  modified_base 5: mod_base = OTHER; note = 5'-methyluridine-3'-phosphate
ttccttgaagtcaagcttctcag

SEQ ID NO: 418 - RNA, 23 nt, synthetic construct
  source 1..23: mol_type = other RNA
  modified_base 7: mod_base = OTHER; note = 5'-methyluridine-3'-phosphate
tgtccttgaagtcaagcttctca

SEQ ID NO: 419 - RNA, 23 nt, synthetic construct
  source 1..23: mol_type = other RNA
  modified_base 7: mod_base = OTHER; note = 5'-methyluridine-3'-phosphate
ttgtccttgaagtcaagcttctc

SEQ ID NO: 420 - RNA, 23 nt, synthetic construct
  source 1..23: mol_type = other RNA
  modified_base 12: mod_base = OTHER; note = 5'-methyluridine-3'-phosphate
tgtaataactttatttccaaatt

SEQ ID NO: 421 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
tagtaataactttatttccaaat

SEQ ID NO: 422 - RNA, 23 nt, synthetic construct
  source 1..23: mol_type = other RNA
  modified_base 7: mod_base = OTHER; note = 5'-methyluridine-3'-phosphate
tagtaataactttatttccaaat

SEQ ID NO: 423 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
tgagtaataactttatttccaaa

SEQ ID NO: 424 - RNA, 23 nt, synthetic construct
  source 1..23: mol_type = other RNA
  modified_base 7: mod_base = OTHER; note = 5'-methyluridine-3'-phosphate
tcagagtaataactttatttcca

SEQ ID NO: 425 - RNA, 23 nt, synthetic construct
  source 1..23: mol_type = other RNA
ttcagagtaataactttatttcc

SEQ ID NO: 426 - RNA, 23 nt, synthetic construct
  source 1..23: mol_type = other RNA
tatcagagtaataactttatttc

SEQ ID NO: 427 - RNA, 23 nt, synthetic construct
  source 1..23: mol_type = other RNA
taatcagagtaataactttattt

SEQ ID NO: 428 - RNA, 23 nt, synthetic construct
  source 1..23: mol_type = other RNA
tgagtaataactttatttccaaa

SEQ ID NO: 429 - RNA, 23 nt, synthetic construct
  source 1..23: mol_type = other RNA
tttgcttttactgaccatgcgag

SEQ ID NO: 430 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acgtgacccaagctcgcatga

SEQ ID NO: 431 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgacccaagctcgcatggta

SEQ ID NO: 432 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgacccaagctcgcatggtca

SEQ ID NO: 433 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acccaagctcgcatggtcaga

SEQ ID NO: 434 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atagtctacaaaccagttgaa

SEQ ID NO: 435 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtctacaaaccagttgaccta

SEQ ID NO: 436 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atctgagaagcttgacttcaa

SEQ ID NO: 437 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-adenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaaataaagttattactctga

SEQ ID NO: 438 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctcgcatggtcagtaaaaga

SEQ ID NO: 439 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctcgcatggtcagtaaaagca

SEQ ID NO: 440 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggtcagtaaaagcaaagaa

SEQ ID NO: 441 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtcagtaaaagcaaagacgga

SEQ ID NO: 442 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-adenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcagtaaaagcaaagacggga

SEQ ID NO: 443 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagtaaaagcaaagacgggaa

SEQ ID NO: 444 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaaatagtctacaaaccaga

SEQ ID NO: 445 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-guanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaatagtctacaaaccagtta

SEQ ID NO: 446 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatagtctacaaaccagttga

SEQ ID NO: 447 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tagtctacaaaccagttgaca

SEQ ID NO: 448 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaaaccagttgacctgaga

SEQ ID NO: 449 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acaaaccagttgacctgagca

SEQ ID NO: 450 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaatttggaaataaagttaa

SEQ ID NO: 451 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaatttggaaataaagttaa

SEQ ID NO: 452 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaatttggaaataaagttata

SEQ ID NO: 453 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatttggaaataaagttatta

SEQ ID NO: 454 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-hexadecyl-adenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atttggaaataaagttattaa

SEQ ID NO: 455 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-hexadecyl-adenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atttggaaataaagttattaa

SEQ ID NO: 456 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggaaataaagttattactcta

SEQ ID NO: 457 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taaagttattactctgattaa

SEQ ID NO: 458 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgacccaagctcgcatggta

SEQ ID NO: 459 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-deoxy-2'-fluorocytidine-3'-phosphate
  modified_base 12: mod_base = OTHER; note = 2'-deoxy-2'-fluorouridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgacccaagctcgcatggta

SEQ ID NO: 460 - DNA, 21 bp, synthetic construct
  source 1..21: mol_type = other DNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 12: mod_base = OTHER; note = 2'-deoxy-2'-fluorouridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..10: note = RNA
  misc_feature 12..21: note = RNA
  misc_feature 11: note = DNA
gtgacccaagctcgcatggta

SEQ ID NO: 461 - DNA, 21 bp, synthetic construct
  source 1..21: mol_type = other DNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-deoxy-2'-fluorocytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..11: note = RNA
  misc_feature 13..21: note = RNA
  misc_feature 12: note = DNA
gtgacccaagctcgcatggta

SEQ ID NO: 462 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgacccaagctcgcatggta

SEQ ID NO: 463 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgacccaagctcgcatggta

SEQ ID NO: 464 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgagccaagctcgcatggta

SEQ ID NO: 465 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgaaccaagctcgcatggta

SEQ ID NO: 466 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgtcccaagctcgcatggta

SEQ ID NO: 467 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtcacccaagctcgcatggta

SEQ ID NO: 468 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gttacccaagctcgcatggta

SEQ ID NO: 469 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgacccaagctcgcatggta

SEQ ID NO: 470 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgacccaagctcgcatggta

SEQ ID NO: 471 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgacccaagctcgcatggta

SEQ ID NO: 472 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgacccaagctcgcatggta

SEQ ID NO: 473 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgacccaagctcgcatggta

SEQ ID NO: 474 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgacccaagctcgcttggta

SEQ ID NO: 475 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgacccaagctcgtatggta

SEQ ID NO: 476 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgacccaagctcgcatggta

SEQ ID NO: 477 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgacccaagctcgcttggta

SEQ ID NO: 478 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgacccaagctcgtatggta

SEQ ID NO: 479 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaaaccagttgacctgaga

SEQ ID NO: 480 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaaaccagttgacctgaga

SEQ ID NO: 481 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaaaccagttgacctgaga

SEQ ID NO: 482 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaaaccagttgacctgaga

SEQ ID NO: 483 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-O-methylguanosine-3'-phosphate
  modified_base 11: mod_base = OTHER; note = 2'-deoxy-2'-fluorouridine-3'-phosphate
  modified_base 12: mod_base = OTHER; note = 2'-deoxy-2'-fluorouridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaaaccagttgacctgaga

SEQ ID NO: 484 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaaaccagttgacctgaga

SEQ ID NO: 485 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaaaccagttgacctgaga

SEQ ID NO: 486 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaaaccagttgacctgaga

SEQ ID NO: 487 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaaaccagttgacctgaga

SEQ ID NO: 488 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaaaccagttgacgtgaga

SEQ ID NO: 489 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaaaccagttgacttgaga

SEQ ID NO: 490 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaaaccagttgatctgaga

SEQ ID NO: 491 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaaaccagttgacgtgaga

SEQ ID NO: 492 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaaaccagttgacttgaga

SEQ ID NO: 493 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaaaccagttgatctgaga

SEQ ID NO: 494 - RNA, 19 nt, synthetic construct
  source 1..19: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-hexadecyl-adenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caaaccagttgacctgaga

SEQ ID NO: 495 - RNA, 19 nt, synthetic construct
  source 1..19: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-hexadecyl-adenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorouridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caaaccagttgacctgaga

SEQ ID NO: 496 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtctacaaaccagttgaccta

SEQ ID NO: 497 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtctacaaaccagttgaccta

SEQ ID NO: 498 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtcttcaaaccagttgaccta

SEQ ID NO: 499 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtcaacaaaccagttgaccta

SEQ ID NO: 500 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgtacaaaccagttgaccta

SEQ ID NO: 501 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtctacaaaccagttgaccta

SEQ ID NO: 502 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtctacaaaccagttgaccta

SEQ ID NO: 503 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtctacaaaccagtttaccta

SEQ ID NO: 504 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtctacaaaccagtttaccta

SEQ ID NO: 505 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atagtctacaaaccagttgaa

SEQ ID NO: 506 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atagtctacaaaccagttgaa

SEQ ID NO: 507 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atagtctacaaaccagttgaa

SEQ ID NO: 508 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atagtctacaaaccagttgaa

SEQ ID NO: 509 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atagtctacaaaccagttgaa

SEQ ID NO: 510 - RNA, 20 nt, synthetic construct
  source 1..20: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-hexadecyl-cytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-deoxy-2'-fluorocytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tagtctacaaaccagttgaa

SEQ ID NO: 511 - RNA, 19 nt, synthetic construct
  source 1..19: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-hexadecyl-cytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-deoxy-2'-fluorocytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtctacaaaccagttgaa

SEQ ID NO: 512 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atagactacaaaccagttgaa

SEQ ID NO: 513 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atactctacaaaccagttgaa

SEQ ID NO: 514 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attgtctacaaaccagttgaa

SEQ ID NO: 515 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atagtctacaaaccaattgaa

SEQ ID NO: 516 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atagtctacaaacctgttgaa

SEQ ID NO: 517 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atagtctacaaacccgttgaa

SEQ ID NO: 518 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atagtctacaaaccggttgaa

SEQ ID NO: 519 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaatagtctacaaaccagtta

SEQ ID NO: 520 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaatagtctacaaaccagtta

SEQ ID NO: 521 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaatagtctacaaaccagtta

SEQ ID NO: 522 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaatagtctacaaaccagtta

SEQ ID NO: 523 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaattgtctacaaaccagtta

SEQ ID NO: 524 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaaagtctacaaaccagtta

SEQ ID NO: 525 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aattagtctacaaaccagtta

SEQ ID NO: 526 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaatagtctacaaaccagtta

SEQ ID NO: 527 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaatagtctacaaaccagtta

SEQ ID NO: 528 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaatagtctacaaacgagtta

SEQ ID NO: 529 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctcgcatggtcagtaaaaga

SEQ ID NO: 530 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctcgcatggtcagtaaaaga

SEQ ID NO: 531 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctcgcatggtcagtaaaaga

SEQ ID NO: 532 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctcccatggtcagtaaaaga

SEQ ID NO: 533 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctggcatggtcagtaaaaga

SEQ ID NO: 534 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcacgcatggtcagtaaaaga

SEQ ID NO: 535 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctcgcatggtcattaaaaga

SEQ ID NO: 536 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctcgcatggtcagttaaaga

SEQ ID NO: 537 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctcccatggtcactaaaaga

SEQ ID NO: 538 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctcccatggtcagttaaaga

SEQ ID NO: 539 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctggcatggtcactaaaaga

SEQ ID NO: 540 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctggcatggtcagttaaaga

SEQ ID NO: 541 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcacgcatggtcactaaaaga

SEQ ID NO: 542 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcacgcatggtcagttaaaga

SEQ ID NO: 543 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atctgagaagcttgacttcaa

SEQ ID NO: 544 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atctgagaagcttgacttcaa

SEQ ID NO: 545 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atctgagaagcttgacttcaa

SEQ ID NO: 546 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atctgagaagcttgacttcaa

SEQ ID NO: 547 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atctgagaagcttgacttcaa

SEQ ID NO: 548 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atctcagaagcttgacttcaa

SEQ ID NO: 549 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-hexadecyl-adenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcttagaagcttgacttcaa

SEQ ID NO: 550 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcagagaagcttgacttcaa

SEQ ID NO: 551 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgtgagaagcttgacttcaa

SEQ ID NO: 552 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atatgagaagcttgacttcaa

SEQ ID NO: 553 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atctgagaagcttgatttcaa

SEQ ID NO: 554 - RNA, 19 nt, synthetic construct
  source 1..19: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-hexadecyl-adenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccgagaagcttgacttcaa

SEQ ID NO: 555 - RNA, 19 nt, synthetic construct
  source 1..19: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-hexadecyl-adenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-deoxy-2'-fluoroadenosine-3'-phosphate
  modified_base 8: mod_base = OTHER; note = 2'-deoxy-2'-fluoroguanosine-3'-phosphate
  modified_base 9: mod_base = OTHER; note = 2'-deoxy-2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccgagaagcttgacttcaa

SEQ ID NO: 556 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggtcagtaaaagcaaagaa

SEQ ID NO: 557 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggtcagtaaaagcaaagaa

SEQ ID NO: 558 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggtcagtaaaagcaaagaa

SEQ ID NO: 559 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-deoxy-2'-fluoroadenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..8: note = RNA
  misc_feature 10..11: note = RNA
  misc_feature 13..21: note = RNA
  misc_feature 9: note = DNA
  misc_feature 12: note = DNA
atggtcagtaaaagcaaagaa

SEQ ID NO: 560 - DNA, 21 bp, synthetic construct
  source 1..21: mol_type = other DNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-deoxy-2'-fluoroadenosine-3'-phosphate
  modified_base 12: mod_base = OTHER; note = 2'-deoxy-2'-fluoroadenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
  misc_feature 1..8: note = RNA
  misc_feature 10..21: note = RNA
  misc_feature 9: note = DNA
atggtcagtaaaagcaaagaa

SEQ ID NO: 561 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggacagtaaaagcaaagaa

SEQ ID NO: 562 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgctcagtaaaagcaaagaa

SEQ ID NO: 563 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcgtcagtaaaagcaaagaa

SEQ ID NO: 564 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagttgacctgagcaaggtga

SEQ ID NO: 565 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtaaaatctgagaagcttga

SEQ ID NO: 566 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtaaaatctgagaagcttgaa

SEQ ID NO: 567 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taaaatctgagaagcttgaca

SEQ ID NO: 568 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaatctgagaagcttgacta

SEQ ID NO: 569 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaatctgagaagcttgactta

SEQ ID NO: 570 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatctgagaagcttgacttca

SEQ ID NO: 571 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atctgagaagcttgacttcaa

SEQ ID NO: 572 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-adenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctgagaagcttgacttcaaa

SEQ ID NO: 573 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgagaagcttgacttcaaga

SEQ ID NO: 574 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgagaagcttgacttcaagga

SEQ ID NO: 575 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-cytidine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagaagcttgacttcaaggaa

SEQ ID NO: 576 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaagcttgacttcaaggaca

SEQ ID NO: 577 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaagcttgacttcaaggacaa

SEQ ID NO: 578 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttggaaataaagttattaca

SEQ ID NO: 579 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttggaaataaagttattacta

SEQ ID NO: 580 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttggaaataaagttattacta

SEQ ID NO: 581 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggaaataaagttattactca

SEQ ID NO: 582 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaaataaagttattactctga

SEQ ID NO: 583 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaataaagttattactctgaa

SEQ ID NO: 584 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aataaagttattactctgata

SEQ ID NO: 585 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ataaagttattactctgatta

SEQ ID NO: 586 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggaaataaagttattactca

SEQ ID NO: 587 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgcatggtcagtaaaagcaaa

SEQ ID NO: 588 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tcatgcgagcttgggtcacgtga

SEQ ID NO: 589 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
taccatgcgagcttgggtcacgt

SEQ ID NO: 590 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tgaccatgcgagcttgggtcacg

SEQ ID NO: 591 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tctgaccatgcgagcttgggtca

SEQ ID NO: 592 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
ttcaactggtttgtagactattt

SEQ ID NO: 593 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
taggtcaactggtttgtagacta

SEQ ID NO: 594 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
ttgaagtcaagcttctcagattt

SEQ ID NO: 595 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tcagagtaataactttatttcca

SEQ ID NO: 596 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tcttttactgaccatgcgagctt

SEQ ID NO: 597 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tgcttttactgaccatgcgagct

SEQ ID NO: 598 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
ttctttgcttttactgaccatgc

SEQ ID NO: 599 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tccgtctttgcttttactgacca

SEQ ID NO: 600 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tcccgtctttgcttttactgacc

SEQ ID NO: 601 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
ttcccgtctttgcttttactgac

SEQ ID NO: 602 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tctggtttgtagactatttgcac

SEQ ID NO: 603 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
taactggtttgtagactatttgc

SEQ ID NO: 604 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tcaactggtttgtagactatttg

SEQ ID NO: 605 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tgtcaactggtttgtagactatt

SEQ ID NO: 606 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
tctcaggtcaactggtttgtaga

SEQ ID NO: 607 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tgctcaggtcaactggtttgtag

SEQ ID NO: 608 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
ttaactttatttccaaattcact

SEQ ID NO: 609 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
ttaactttatttccaaattcact

SEQ ID NO: 610 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
tataactttatttccaaattcac

SEQ ID NO: 611 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
taataactttatttccaaattca

SEQ ID NO: 612 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
ttaataactttatttccaaattc

SEQ ID NO: 613 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
ttaataactttatttccaaattc

SEQ ID NO: 614 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tagagtaataactttatttccaa

SEQ ID NO: 615 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
ttaatcagagtaataactttatt

SEQ ID NO: 616 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..11: note = RNA
  misc_feature 13..23: note = RNA
  misc_feature 5: note = DNA
  misc_feature 12: note = DNA
taccatgcgagcttgggtcacgt

SEQ ID NO: 617 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..11: note = RNA
  misc_feature 13..23: note = RNA
  misc_feature 5: note = DNA
  misc_feature 12: note = DNA
taccatgcgagcttgggtcacgt

SEQ ID NO: 618 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..11: note = RNA
  misc_feature 13..23: note = RNA
  misc_feature 5: note = DNA
  misc_feature 12: note = DNA
taccatgcgagcttgggtcacgt

SEQ ID NO: 619 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..11: note = RNA
  misc_feature 13..23: note = RNA
  misc_feature 5: note = DNA
  misc_feature 12: note = DNA
taccatgcgagcttgggtcacgt

SEQ ID NO: 620 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..11: note = RNA
  misc_feature 13..15: note = RNA
  misc_feature 17..23: note = RNA
  misc_feature 5: note = DNA
  misc_feature 12: note = DNA
  misc_feature 16: note = DNA
taccatgcgagcttgggtcacgt

SEQ ID NO: 621 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6..11: note = RNA
  misc_feature 13..15: note = RNA
  misc_feature 17..23: note = RNA
  misc_feature 2: note = DNA
  misc_feature 5: note = DNA
  misc_feature 12: note = DNA
  misc_feature 16: note = DNA
taccatgcgagcttgggtcacgt

SEQ ID NO: 622 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
taccatgcgagcttggctcacgt

SEQ ID NO: 623 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
taccatgcgagcttggttcacgt

SEQ ID NO: 624 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
taccatgcgagcttgggacacgt

SEQ ID NO: 625 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
taccatgcgagcttgggtgacgt

SEQ ID NO: 626 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
taccatgcgagcttgggtaacgt

SEQ ID NO: 627 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = Thymidine-glycol nucleic acid (GNA), S-Isomer
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..3: note = RNA
  misc_feature 5..23: note = RNA
  misc_feature 4: note = DNA
taccatgcgagcttgggtcacgt

SEQ ID NO: 628 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = Thymidine-glycol nucleic acid (GNA), S-Isomer
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..3: note = RNA
  misc_feature 5..11: note = RNA
  misc_feature 13..23: note = RNA
  misc_feature 4: note = DNA
  misc_feature 12: note = DNA
taccatgcgagcttgggtcacgt

SEQ ID NO: 629 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = Thymidine-glycol nucleic acid (GNA), S-Isomer
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..3: note = RNA
  misc_feature 5..11: note = RNA
  misc_feature 13..15: note = RNA
  misc_feature 17..23: note = RNA
  misc_feature 4: note = DNA
  misc_feature 12: note = DNA
  misc_feature 16: note = DNA
taccatgcgagcttgggtcacgt

SEQ ID NO: 630 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = Thymidine-glycol nucleic acid (GNA), S-Isomer
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3: note = RNA
  misc_feature 5..11: note = RNA
  misc_feature 13..15: note = RNA
  misc_feature 17..23: note = RNA
  misc_feature 2: note = DNA
  misc_feature 4: note = DNA
  misc_feature 12: note = DNA
  misc_feature 16: note = DNA
taccatgcgagcttgggtcacgt

SEQ ID NO: 631 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6: note = RNA
  misc_feature 8..23: note = RNA
  misc_feature 5: note = DNA
  misc_feature 7: note = DNA
taccatgcgagcttgggtcacgt

SEQ ID NO: 632 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6: note = RNA
  misc_feature 8..23: note = RNA
  misc_feature 5: note = DNA
  misc_feature 7: note = DNA
taccaagcgagcttgggtcacgt

SEQ ID NO: 633 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6: note = RNA
  misc_feature 8..23: note = RNA
  misc_feature 5: note = DNA
  misc_feature 7: note = DNA
taccatacgagcttgggtcacgt

SEQ ID NO: 634 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
taccatgcgagcttgggtcacgt

SEQ ID NO: 635 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
taccaagcgagcttgggtcacgt

SEQ ID NO: 636 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
taccatacgagcttgggtcacgt

SEQ ID NO: 637 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6..11: note = RNA
  misc_feature 13..23: note = RNA
  misc_feature 2: note = DNA
  misc_feature 5: note = DNA
  misc_feature 12: note = DNA
tctcaggtcaactggtttgtagg

SEQ ID NO: 638 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..11: note = RNA
  misc_feature 13..15: note = RNA
  misc_feature 17..23: note = RNA
  misc_feature 5: note = DNA
  misc_feature 12: note = DNA
  misc_feature 16: note = DNA
tctcaggtcaactggtttgtagg

SEQ ID NO: 639 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6..11: note = RNA
  misc_feature 13..15: note = RNA
  misc_feature 17..23: note = RNA
  misc_feature 2: note = DNA
  misc_feature 5: note = DNA
  misc_feature 12: note = DNA
  misc_feature 16: note = DNA
tctcaggtcaactggtttgtagg

SEQ ID NO: 640 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6..11: note = RNA
  misc_feature 13: note = RNA
  misc_feature 15: note = RNA
  misc_feature 17..23: note = RNA
  misc_feature 2: note = DNA
  misc_feature 5: note = DNA
  misc_feature 12: note = DNA
  misc_feature 14: note = DNA
  misc_feature 16: note = DNA
tctcaggtcaactggtttgtagg

SEQ ID NO: 641 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..11: note = RNA
  misc_feature 13..23: note = RNA
  misc_feature 5: note = DNA
  misc_feature 12: note = DNA
tctcaggtcaactggtttgtaga

SEQ ID NO: 642 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = Thymidine-glycol nucleic acid (GNA), S-Isomer
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..5: note = RNA
  misc_feature 7..23: note = RNA
  misc_feature 6: note = DNA
tctcaggtcaactggtttgtagg

SEQ ID NO: 643 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = Thymidine-glycol nucleic acid (GNA), S-Isomer
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..5: note = RNA
  misc_feature 7..11: note = RNA
  misc_feature 13..15: note = RNA
  misc_feature 17..23: note = RNA
  misc_feature 6: note = DNA
  misc_feature 12: note = DNA
  misc_feature 16: note = DNA
tctcaggtcaactggtttgtagg

SEQ ID NO: 644 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = Thymidine-glycol nucleic acid (GNA), S-Isomer
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..5: note = RNA
  misc_feature 7..11: note = RNA
  misc_feature 13: note = RNA
  misc_feature 15: note = RNA
  misc_feature 17..23: note = RNA
  misc_feature 2: note = DNA
  misc_feature 6: note = DNA
  misc_feature 12: note = DNA
  misc_feature 14: note = DNA
  misc_feature 16: note = DNA
tctcaggtcaactggtttgtagg

SEQ ID NO: 645 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6: note = RNA
  misc_feature 8..23: note = RNA
  misc_feature 5: note = DNA
  misc_feature 7: note = DNA
tctcaggtcaactggtttgtagg

SEQ ID NO: 646 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6: note = RNA
  misc_feature 8..23: note = RNA
  misc_feature 5: note = DNA
  misc_feature 7: note = DNA
tctcacgtcaactggtttgtagg

SEQ ID NO: 647 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6: note = RNA
  misc_feature 8..23: note = RNA
  misc_feature 5: note = DNA
  misc_feature 7: note = DNA
tctcaagtcaactggtttgtagg

SEQ ID NO: 648 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6: note = RNA
  misc_feature 8..23: note = RNA
  misc_feature 5: note = DNA
  misc_feature 7: note = DNA
tctcagatcaactggtttgtagg

SEQ ID NO: 649 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tctcacgtcaactggtttgtagg

SEQ ID NO: 650 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tctcaagtcaactggtttgtagg

SEQ ID NO: 651 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tctcagatcaactggtttgtagg

SEQ ID NO: 652 - DNA, 21 bp, synthetic construct
  source 1..21: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methylguanosine
  misc_feature 1..4: note = RNA
  misc_feature 6..21: note = RNA
  misc_feature 5: note = DNA
tctcaggtcaactggtttgtg

SEQ ID NO: 653 - DNA, 21 bp, synthetic construct
  source 1..21: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methylguanosine
  misc_feature 1: note = RNA
  misc_feature 3..4: note = RNA
  misc_feature 6..11: note = RNA
  misc_feature 13..21: note = RNA
  misc_feature 2: note = DNA
  misc_feature 5: note = DNA
  misc_feature 12: note = DNA
tctcaggtcaactggtttgtg

SEQ ID NO: 654 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
taggtcaactggtttgtagactg

SEQ ID NO: 655 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-deoxy-2'-fluorouridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
taggtcaactggtttgtagactg

SEQ ID NO: 656 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
taggtcaactggtttgaagactg

SEQ ID NO: 657 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
taggtcaactggtttgttgactg

SEQ ID NO: 658 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
taggtcaactggtttgtacactg

SEQ ID NO: 659 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
taggtcaactggtttgtagactg

SEQ ID NO: 660 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6..11: note = RNA
  misc_feature 13..23: note = RNA
  misc_feature 2: note = DNA
  misc_feature 5: note = DNA
  misc_feature 12: note = DNA
taggtcaactggtttgtagactg

SEQ ID NO: 661 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6: note = RNA
  misc_feature 8..23: note = RNA
  misc_feature 5: note = DNA
  misc_feature 7: note = DNA
taggtaaactggtttgtagactg

SEQ ID NO: 662 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
taggtaaactggtttgtagactg

SEQ ID NO: 663 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..15: note = RNA
  misc_feature 17..23: note = RNA
  misc_feature 5: note = DNA
  misc_feature 16: note = DNA
ttcaactggtttgtagactattt

SEQ ID NO: 664 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..11: note = RNA
  misc_feature 13..15: note = RNA
  misc_feature 17..23: note = RNA
  misc_feature 5: note = DNA
  misc_feature 12: note = DNA
  misc_feature 16: note = DNA
ttcaactggtttgtagactattt

SEQ ID NO: 665 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..11: note = RNA
  misc_feature 13..23: note = RNA
  misc_feature 5: note = DNA
  misc_feature 12: note = DNA
ttcaactggtttgtagactattt

SEQ ID NO: 666 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6..11: note = RNA
  misc_feature 13..23: note = RNA
  misc_feature 2: note = DNA
  misc_feature 5: note = DNA
  misc_feature 12: note = DNA
ttcaactggtttgtagactattt

SEQ ID NO: 667 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6..11: note = RNA
  misc_feature 13..15: note = RNA
  misc_feature 17..23: note = RNA
  misc_feature 2: note = DNA
  misc_feature 5: note = DNA
  misc_feature 12: note = DNA
  misc_feature 16: note = DNA
ttcaactggtttgtagactatct

SEQ ID NO: 668 - DNA, 22 bp, synthetic construct
  source 1..22: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphorothioate
  modified_base 21: mod_base = OTHER; note = 2'-O-methyluridine-3'-phosphorothioate
  modified_base 22: mod_base = OTHER; note = 2'-O-methylcytidine
  misc_feature 1..4: note = RNA
  misc_feature 6..11: note = RNA
  misc_feature 13..15: note = RNA
  misc_feature 17..22: note = RNA
  misc_feature 5: note = DNA
  misc_feature 12: note = DNA
  misc_feature 16: note = DNA
ttcaactggtttgtagactatc

SEQ ID NO: 669 - DNA, 21 bp, synthetic construct
  source 1..21: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyluridine
  misc_feature 1..4: note = RNA
  misc_feature 6..11: note = RNA
  misc_feature 13..15: note = RNA
  misc_feature 17..21: note = RNA
  misc_feature 5: note = DNA
  misc_feature 12: note = DNA
  misc_feature 16: note = DNA
ttcaactggtttgtagactgt

SEQ ID NO: 670 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6..11: note = RNA
  misc_feature 13..15: note = RNA
  misc_feature 17..23: note = RNA
  misc_feature 2: note = DNA
  misc_feature 5: note = DNA
  misc_feature 12: note = DNA
  misc_feature 16: note = DNA
ttcaactggtttgtagtctatct

SEQ ID NO: 671 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6..11: note = RNA
  misc_feature 13..15: note = RNA
  misc_feature 17..23: note = RNA
  misc_feature 2: note = DNA
  misc_feature 5: note = DNA
  misc_feature 12: note = DNA
  misc_feature 16: note = DNA
ttcaactggtttgtagagtatct

SEQ ID NO: 672 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6..11: note = RNA
  misc_feature 13..15: note = RNA
  misc_feature 17..23: note = RNA
  misc_feature 2: note = DNA
  misc_feature 5: note = DNA
  misc_feature 12: note = DNA
  misc_feature 16: note = DNA
ttcaactggtttgtagacaatct

SEQ ID NO: 673 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
ttcaattggtttgtagactatct

SEQ ID NO: 674 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
ttcaacaggtttgtagactatct

SEQ ID NO: 675 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
ttcaacgggtttgtagactatct

SEQ ID NO: 676 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
ttcaaccggtttgtagactatct

SEQ ID NO: 677 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
taactggtttgtagactatttgc

SEQ ID NO: 678 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..4: note = RNA
  misc_feature 6..11: note = RNA
  misc_feature 13..23: note = RNA
  misc_feature 5: note = DNA
  misc_feature 12: note = DNA
taactggtttgtagactatttgc

SEQ ID NO: 679 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6..11: note = RNA
  misc_feature 13..23: note = RNA
  misc_feature 2: note = DNA
  misc_feature 5: note = DNA
  misc_feature 12: note = DNA
taactggtttgtagactatttgc

SEQ ID NO: 680 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1: note = RNA
  misc_feature 3..4: note = RNA
  misc_feature 6..11: note = RNA
  misc_feature 13: note = RNA
  misc_feature 15: note = RNA
  misc_feature 17..23: note = RNA
  misc_feature 2: note = DNA
  misc_feature 5: note = DNA
  misc_feature 12: note = DNA
  misc_feature 14: note = DNA
  misc_feature 16: note = DNA
taactggtttgtagactatttct

SEQ ID NO: 681 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
taactggtttgtagacaatttgc

SEQ ID NO: 682 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
taactggtttgtagactttttgc

SEQ ID NO: 683 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
taactggtttgtagactaattgc

SEQ ID NO: 684 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = Thymidine-glycol nucleic acid (GNA), S-Isomer
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..5: note = RNA
  misc_feature 7..23: note = RNA
  misc_feature 6: note = DNA
taactggtttgtagactatttgc

SEQ ID NO: 685 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = Thymidine-glycol nucleic acid (GNA), S-Isomer
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..5: note = RNA
  misc_feature 7..11: note = RNA
  misc_feature 13..23: note = RNA
  misc_feature 6: note = DNA
  misc_feature 12: note = DNA
taactggtttgtagactatttgc

SEQ ID NO: 686 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
taactcgtttgtagactatttgc

SEQ ID NO: 687 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..11: note = RNA
  misc_feature 13..23: note = RNA
  misc_feature 5: note = DNA
  misc_feature 12: note = DNA
tcttttactgaccatgcgagctt

SEQ ID NO: 688 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
tcttttactgaccatgcgagctt

SEQ ID NO: 689 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..11: note = RNA
  misc_feature 13..23: note = RNA
  misc_feature 5: note = DNA
  misc_feature 12: note = DNA
tcttttactgaccatgcgagctt

SEQ ID NO: 690 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
tcttttactgaccatgggagctt

SEQ ID NO: 691 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
tcttttactgaccatgccagctt

SEQ ID NO: 692 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
tcttttactgaccatgcgtgctt

SEQ ID NO: 693 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tcttttaatgaccatgcgagctt

SEQ ID NO: 694 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tctttaactgaccatgcgagctt

SEQ ID NO: 695 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tcttttaatgaccatgggagctt

SEQ ID NO: 696 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tctttaactgaccatgggagctt

SEQ ID NO: 697 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tcttttaatgaccatgccagctt

SEQ ID NO: 698 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tctttaactgaccatgccagctt

SEQ ID NO: 699 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tcttttaatgaccatgcgtgctt

SEQ ID NO: 700 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tctttaactgaccatgcgtgctt

SEQ ID NO: 701 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = Cytidine-glycol nucleic acid (GNA), S-isomer
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..5: note = RNA
  misc_feature 7..23: note = RNA
  misc_feature 6: note = DNA
ttgaagtcaagcttctcagattt

SEQ ID NO: 702 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..11: note = RNA
  misc_feature 13..23: note = RNA
  misc_feature 5: note = DNA
  misc_feature 12: note = DNA
ttgaagtcaagcttctcagattt

SEQ ID NO: 703 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..11: note = RNA
  misc_feature 13..15: note = RNA
  misc_feature 17..23: note = RNA
  misc_feature 5: note = DNA
  misc_feature 12: note = DNA
  misc_feature 16: note = DNA
ttgaagtcaagcttctcagattt

SEQ ID NO: 704 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6..11: note = RNA
  misc_feature 13..15: note = RNA
  misc_feature 17..23: note = RNA
  misc_feature 2: note = DNA
  misc_feature 5: note = DNA
  misc_feature 12: note = DNA
  misc_feature 16: note = DNA
ttgaagtcaagcttctcagattt

SEQ ID NO: 705 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6..11: note = RNA
  misc_feature 13: note = RNA
  misc_feature 15: note = RNA
  misc_feature 17..23: note = RNA
  misc_feature 2: note = DNA
  misc_feature 5: note = DNA
  misc_feature 12: note = DNA
  misc_feature 14: note = DNA
  misc_feature 16: note = DNA
ttgaagtcaagcttctcagattt

SEQ ID NO: 706 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..11: note = RNA
  misc_feature 13..23: note = RNA
  misc_feature 5: note = DNA
  misc_feature 12: note = DNA
ttgaagtcaagcttctgagattt

SEQ ID NO: 707 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..11: note = RNA
  misc_feature 13..23: note = RNA
  misc_feature 5: note = DNA
  misc_feature 12: note = DNA
ttgaagtcaagcttctaagattt

SEQ ID NO: 708 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..11: note = RNA
  misc_feature 13..23: note = RNA
  misc_feature 5: note = DNA
  misc_feature 12: note = DNA
ttgaagtcaagcttctctgattt

SEQ ID NO: 709 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..11: note = RNA
  misc_feature 13..23: note = RNA
  misc_feature 5: note = DNA
  misc_feature 12: note = DNA
ttgaagtcaagcttctcacattt

SEQ ID NO: 710 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..11: note = RNA
  misc_feature 13..23: note = RNA
  misc_feature 5: note = DNA
  misc_feature 12: note = DNA
ttgaagtcaagcttctcatattt

SEQ ID NO: 711 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6: note = RNA
  misc_feature 8..23: note = RNA
  misc_feature 5: note = DNA
  misc_feature 7: note = DNA
ttgaaatcaagcttctcagattt

SEQ ID NO: 712 - DNA, 21 bp, synthetic construct
  source 1..21: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methyluridine
  misc_feature 1..4: note = RNA
  misc_feature 6..21: note = RNA
  misc_feature 5: note = DNA
ttgaagtcaagcttctcaggt

SEQ ID NO: 713 - DNA, 21 bp, synthetic construct
  source 1..21: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methyluridine
  misc_feature 1: note = RNA
  misc_feature 3..4: note = RNA
  misc_feature 6..11: note = RNA
  misc_feature 13..15: note = RNA
  misc_feature 17..21: note = RNA
  misc_feature 2: note = DNA
  misc_feature 5: note = DNA
  misc_feature 12: note = DNA
  misc_feature 16: note = DNA
ttgaagtcaagcttctcaggt

SEQ ID NO: 714 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..4: note = RNA
  misc_feature 6..11: note = RNA
  misc_feature 13..23: note = RNA
  misc_feature 5: note = DNA
  misc_feature 12: note = DNA
ttctttgcttttactgaccatgc

SEQ ID NO: 715 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..4: note = RNA
  misc_feature 6..11: note = RNA
  misc_feature 13..15: note = RNA
  misc_feature 17..23: note = RNA
  misc_feature 5: note = DNA
  misc_feature 12: note = DNA
  misc_feature 16: note = DNA
ttctttgcttttactgaccatgc

SEQ ID NO: 716 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6..11: note = RNA
  misc_feature 13..15: note = RNA
  misc_feature 17..23: note = RNA
  misc_feature 2: note = DNA
  misc_feature 5: note = DNA
  misc_feature 12: note = DNA
  misc_feature 16: note = DNA
ttctttgcttttactgaccatgc

SEQ ID NO: 717 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6..11: note = RNA
  misc_feature 13..15: note = RNA
  misc_feature 17..23: note = RNA
  misc_feature 2: note = DNA
  misc_feature 5: note = DNA
  misc_feature 12: note = DNA
  misc_feature 16: note = DNA
ttctttgcttttactgaccatgc

SEQ ID NO: 718 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6..11: note = RNA
  misc_feature 13..15: note = RNA
  misc_feature 17..23: note = RNA
  misc_feature 2: note = DNA
  misc_feature 5: note = DNA
  misc_feature 12: note = DNA
  misc_feature 16: note = DNA
ttctttgcttttactgaccatgc

SEQ ID NO: 719 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6..11: note = RNA
  misc_feature 13..15: note = RNA
  misc_feature 17..23: note = RNA
  misc_feature 2: note = DNA
  misc_feature 5: note = DNA
  misc_feature 12: note = DNA
  misc_feature 16: note = DNA
ttctttgcttttactgtccatgc

SEQ ID NO: 720 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6..11: note = RNA
  misc_feature 13..15: note = RNA
  misc_feature 17..23: note = RNA
  misc_feature 2: note = DNA
  misc_feature 5: note = DNA
  misc_feature 12: note = DNA
  misc_feature 16: note = DNA
ttctttgcttttactgagcatgc

SEQ ID NO: 721 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6..11: note = RNA
  misc_feature 13..15: note = RNA
  misc_feature 17..23: note = RNA
  misc_feature 2: note = DNA
  misc_feature 5: note = DNA
  misc_feature 12: note = DNA
  misc_feature 16: note = DNA
ttctttgcttttactgacgatgc

SEQ ID NO: 722 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = Thymidine-glycol nucleic acid (GNA), S-Isomer
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..3: note = RNA
  misc_feature 5..23: note = RNA
  misc_feature 4: note = DNA
ttctttgcttttactgaccatgc

SEQ ID NO: 723 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = Thymidine-glycol nucleic acid (GNA), S-Isomer
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..3: note = RNA
  misc_feature 5..11: note = RNA
  misc_feature 13..23: note = RNA
  misc_feature 4: note = DNA
  misc_feature 12: note = DNA
ttctttgcttttactgaccatgc

SEQ ID NO: 724 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = Thymidine-glycol nucleic acid (GNA), S-Isomer
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3: note = RNA
  misc_feature 5..11: note = RNA
  misc_feature 13..23: note = RNA
  misc_feature 2: note = DNA
  misc_feature 4: note = DNA
  misc_feature 12: note = DNA
ttctttgcttttactgaccatgc

SEQ ID NO: 725 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
ttcttcgcttttactgaccatgc

SEQ ID NO: 726 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
ttctttacttttactgaccatgc

SEQ ID NO: 727 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
ttcttttcttttactgaccatgc

SEQ ID NO: 728 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = Adenosine-glycol nucleic acid (GNA), S-isomer
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..3: note = RNA
  misc_feature 5..23: note = RNA
  misc_feature 4: note = DNA
tgctcaggtcaactggtttgtag

SEQ ID NO: 729 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = Adenosine-glycol nucleic acid (GNA), S-isomer
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..3: note = RNA
  misc_feature 5..23: note = RNA
  misc_feature 4: note = DNA
tgctcaggtcaactggattgtag

SEQ ID NO: 730 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = Adenosine-glycol nucleic acid (GNA), S-isomer
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..3: note = RNA
  misc_feature 5..23: note = RNA
  misc_feature 4: note = DNA
tgctcaggtcaactggtatgtag

SEQ ID NO: 731 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = Adenosine-glycol nucleic acid (GNA), S-isomer
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..3: note = RNA
  misc_feature 5..23: note = RNA
  misc_feature 4: note = DNA
tgctcaggtcaactggttagtag

SEQ ID NO: 732 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6: note = RNA
  misc_feature 8..23: note = RNA
  misc_feature 5: note = DNA
  misc_feature 7: note = DNA
tgctcaagtcaactggtttgtag

SEQ ID NO: 733 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6: note = RNA
  misc_feature 8..23: note = RNA
  misc_feature 5: note = DNA
  misc_feature 7: note = DNA
tgctcaagtcaactggattgtag

SEQ ID NO: 734 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6: note = RNA
  misc_feature 8..23: note = RNA
  misc_feature 5: note = DNA
  misc_feature 7: note = DNA
tgctcaagtcaactggtatgtag

SEQ ID NO: 735 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6: note = RNA
  misc_feature 8..23: note = RNA
  misc_feature 5: note = DNA
  misc_feature 7: note = DNA
tgctcaagtcaactggttagtag

SEQ ID NO: 736 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6: note = RNA
  misc_feature 8..23: note = RNA
  misc_feature 5: note = DNA
  misc_feature 7: note = DNA
tgctctggtcaactggtttgtag

SEQ ID NO: 737 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6: note = RNA
  misc_feature 8..23: note = RNA
  misc_feature 5: note = DNA
  misc_feature 7: note = DNA
tgctctggtcaactggattgtag

SEQ ID NO: 738 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6: note = RNA
  misc_feature 8..23: note = RNA
  misc_feature 5: note = DNA
  misc_feature 7: note = DNA
tgctctggtcaactggtatgtag

SEQ ID NO: 739 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6: note = RNA
  misc_feature 8..23: note = RNA
  misc_feature 5: note = DNA
  misc_feature 7: note = DNA
tgctctggtcaactggttagtag

SEQ ID NO: 740 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
tcagagtaataactttatttcca

SEQ ID NO: 741 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
ttcagagtaataactttatttcc

SEQ ID NO: 742 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
tatcagagtaataactttatttc

SEQ ID NO: 743 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
taatcagagtaataactttattt

SEQ ID NO: 744 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tgagtaataactttatttccaaa

SEQ ID NO: 745 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
tttgcttttactgaccatgcgag

SEQ ID NO: 746 - RNA, 23 nt, synthetic construct
  source 1..23: mol_type = other RNA
tcacgtgacccaagctcgcatgg

SEQ ID NO: 747 - RNA, 23 nt, synthetic construct
  source 1..23: mol_type = other RNA
acgtgacccaagctcgcatggtc

SEQ ID NO: 748 - RNA, 23 nt, synthetic construct
  source 1..23: mol_type = other RNA
cgtgacccaagctcgcatggtca

SEQ ID NO: 749 - RNA, 23 nt, synthetic construct
  source 1..23: mol_type = other RNA
tgacccaagctcgcatggtcagt

SEQ ID NO: 750 - RNA, 23 nt, synthetic construct
  source 1..23: mol_type = other RNA
aaatagtctacaaaccagttgac

SEQ ID NO: 751 - RNA, 23 nt, synthetic construct
  source 1..23: mol_type = other RNA
tagtctacaaaccagttgacctg

SEQ ID NO: 752 - RNA, 23 nt, synthetic construct
  source 1..23: mol_type = other RNA
aaatctgagaagcttgacttcaa

SEQ ID NO: 753 - RNA, 23 nt, synthetic construct
  source 1..23: mol_type = other RNA
tggaaataaagttattactctga

SEQ ID NO: 754 - RNA, 23 nt, synthetic construct
  source 1..23: mol_type = other RNA
aagctcgcatggtcagtaaaagc

SEQ ID NO: 755 - RNA, 23 nt, synthetic construct
  source 1..23: mol_type = other RNA
agctcgcatggtcagtaaaagca

SEQ ID NO: 756 - RNA, 23 nt, synthetic construct
  source 1..23: mol_type = other RNA
gcatggtcagtaaaagcaaagac

SEQ ID NO: 757 - RNA, 23 nt, synthetic construct
  source 1..23: mol_type = other RNA
tggtcagtaaaagcaaagacggg

SEQ ID NO: 758 - RNA, 23 nt, synthetic construct
  source 1..23: mol_type = other RNA
ggtcagtaaaagcaaagacggga

SEQ ID NO: 759 - RNA, 23 nt, synthetic construct
  source 1..23: mol_type = other RNA
gtcagtaaaagcaaagacgggac

SEQ ID NO: 760 - RNA, 23 nt, synthetic construct
  source 1..23: mol_type = other RNA
gtgcaaatagtctacaaaccagt

SEQ ID NO: 761 - RNA, 23 nt, synthetic construct
  source 1..23: mol_type = other RNA
gcaaatagtctacaaaccagttg

SEQ ID NO: 762 - RNA, 23 nt, synthetic construct
  source 1..23: mol_type = other RNA
caaatagtctacaaaccagttga

SEQ ID NO: 763 - RNA, 23 nt, synthetic construct
  source 1..23: mol_type = other RNA
aatagtctacaaaccagttgacc

SEQ ID NO: 764 - RNA, 23 nt, synthetic construct
  source 1..23: mol_type = other RNA
tctacaaaccagttgacctgagc

SEQ ID NO: 765 - RNA, 23 nt, synthetic construct
  source 1..23: mol_type = other RNA
ctacaaaccagttgacctgagca

SEQ ID NO: 766 - RNA, 23 nt, synthetic construct
  source 1..23: mol_type = other RNA
agtgaatttggaaataaagttat

SEQ ID NO: 767 - RNA, 23 nt, synthetic construct
  source 1..23: mol_type = other RNA
agtgaatttggaaataaagttat

SEQ ID NO: 768 - RNA, 23 nt, synthetic construct
  source 1..23: mol_type = other RNA
gtgaatttggaaataaagttatt

SEQ ID NO: 769 - RNA, 23 nt, synthetic construct
  source 1..23: mol_type = other RNA
tgaatttggaaataaagttatta

SEQ ID NO: 770 - RNA, 23 nt, synthetic construct
  source 1..23: mol_type = other RNA
gaatttggaaataaagttattac

SEQ ID NO: 771 - RNA, 23 nt, synthetic construct
  source 1..23: mol_type = other RNA
gaatttggaaataaagttattac

SEQ ID NO: 772 - RNA, 23 nt, synthetic construct
  source 1..23: mol_type = other RNA
ttggaaataaagttattactctg

SEQ ID NO: 773 - RNA, 23 nt, synthetic construct
  source 1..23: mol_type = other RNA
aataaagttattactctgattaa

SEQ ID NO: 774 - RNA, 23 nt, synthetic construct
  source 1..23: mol_type = other RNA
acgtgacccaagctcgcatggtc

SEQ ID NO: 775 - RNA, 23 nt, synthetic construct
  source 1..23: mol_type = other RNA
acgtgacccaagctcgcatggtc

SEQ ID NO: 776 - RNA, 23 nt, synthetic construct
  source 1..23: mol_type = other RNA
acgtgacccaagctcgcatggtc

SEQ ID NO: 777 - RNA, 23 nt, synthetic construct
  source 1..23: mol_type = other RNA
acgtgacccaagctcgcatggtc

SEQ ID NO: 778 - RNA, 23 nt, synthetic construct
  source 1..23: mol_type = other RNA
acgtgacccaagctcgcatggtc

SEQ ID NO: 779 - RNA, 23 nt, synthetic construct
  source 1..23: mol_type = other RNA
acgtgacccaagctcgcatggtc

SEQ ID NO: 780 - RNA, 23 nt, synthetic construct
  source 1..23: mol_type = other RNA
acgtgacccaagctcgcatggtc

SEQ ID NO: 781 - RNA, 23 nt, synthetic construct
  source 1..23: mol_type = other RNA
acgtgacccaagctcgcatggtc

SEQ ID NO: 782 - RNA, 23 nt, synthetic construct
  source 1..23: mol_type = other RNA
acgtgacccaagctcgcatggtc

SEQ ID NO: 783 - RNA, 23 nt, synthetic construct
  source 1..23: mol_type = other RNA
acgtgacccaagctcgcatggtc

SEQ ID NO: 784 - RNA, 23 nt, synthetic construct
  source 1..23: mol_type = other RNA
acgtgacccaagctcgcatggtc

SEQ ID NO: 785 - RNA, 23 nt, synthetic construct
  source 1..23: mol_type = other RNA
acgtgacccaagctcgcatggtc

SEQ ID NO: 786 - RNA, 23 nt, synthetic construct
  source 1..23: mol_type = other RNA
acgtgacccaagctcgcatggtc

SEQ ID NO: 787 - RNA, 23 nt, synthetic construct
  source 1..23: mol_type = other RNA
acgtgacccaagctcgcatggtc

SEQ ID NO: 788 - RNA, 23 nt, synthetic construct
  source 1..23: mol_type = other RNA
acgtgacccaagctcgcatggtc

SEQ ID NO: 789 - RNA, 23 nt, synthetic construct
  source 1..23: mol_type = other RNA
acgtgacccaagctcgcatggtc

SEQ ID NO: 790 - RNA, 23 nt, synthetic construct
  source 1..23: mol_type = other RNA
acgtgacccaagctcgcatggtc

SEQ ID NO: 791 - RNA, 23 nt, synthetic construct
  source 1..23: mol_type = other RNA
acgtgacccaagctcgcatggtc

SEQ ID NO: 792 - RNA, 23 nt, synthetic construct
  source 1..23: mol_type = other RNA
acgtgacccaagctcgcatggtc

SEQ ID NO: 793 - RNA, 23 nt, synthetic construct
  source 1..23: mol_type = other RNA
acgtgacccaagctcgcatggtc

SEQ ID NO: 794 - RNA, 23 nt, synthetic construct
  source 1..23: mol_type = other RNA
acgtgacccaagctcgcatggtc

SEQ ID NO: 795 - RNA, 23 nt, synthetic construct
  source 1..23: mol_type = other RNA
tctacaaaccagttgacctgagc

SEQ ID NO: 796 - RNA, 23 nt, synthetic construct
  source 1..23: mol_type = other RNA
tctacaaaccagttgacctgagc

SEQ ID NO: 797 - RNA, 23 nt, synthetic construct
  source 1..23: mol_type = other RNA
tctacaaaccagttgacctgagc

SEQ ID NO: 798 - RNA, 23 nt, synthetic construct
  source 1..23: mol_type = other RNA
tctacaaaccagttgacctgagc

SEQ ID NO: 799 - RNA, 23 nt, synthetic construct
  source 1..23: mol_type = other RNA
tctacaaaccagttgacctgagc

SEQ ID NO: 800 - RNA, 23 nt, synthetic construct
  source 1..23: mol_type = other RNA
tctacaaaccagttgacctgagc

SEQ ID NO: 801 - RNA, 23 nt, synthetic construct
  source 1..23: mol_type = other RNA
tctacaaaccagttgacctgagc

SEQ ID NO: 802 - RNA, 23 nt, synthetic construct
  source 1..23: mol_type = other RNA
tctacaaaccagttgacctgagc

SEQ ID NO: 803 - RNA, 23 nt, synthetic construct
  source 1..23: mol_type = other RNA
tctacaaaccagttgacctgagc

SEQ ID NO: 804 - RNA, 23 nt, synthetic construct
  source 1..23: mol_type = other RNA
tctacaaaccagttgacctgagc

SEQ ID NO: 805 - RNA, 23 nt, synthetic construct
  source 1..23: mol_type = other RNA
tctacaaaccagttgacctgagc

SEQ ID NO: 806 - RNA, 23 nt, synthetic construct
  source 1..23: mol_type = other RNA
tctacaaaccagttgacctgagc

SEQ ID NO: 807 - RNA, 23 nt, synthetic construct
  source 1..23: mol_type = other RNA
tctacaaaccagttgacctgagc

SEQ ID NO: 808 - RNA, 23 nt, synthetic construct
  source 1..23: mol_type = other RNA
tctacaaaccagttgacctgagc

SEQ ID NO: 809 - RNA, 23 nt, synthetic construct
  source 1..23: mol_type = other RNA
tctacaaaccagttgacctgagc

SEQ ID NO: 810 - RNA, 21 nt, synthetic construct
  source 1..21: mol_type = other RNA
tacaaaccagttgacctgagc

SEQ ID NO: 811 - RNA, 21 nt, synthetic construct
  source 1..21: mol_type = other RNA
tacaaaccagttgacctgagc

SEQ ID NO: 812 - RNA, 23 nt, synthetic construct
  source 1..23: mol_type = other RNA
tagtctacaaaccagttgacctg

SEQ ID NO: 813 - RNA, 23 nt, synthetic construct
  source 1..23: mol_type = other RNA
tagtctacaaaccagttgacctg

SEQ ID NO: 814 - RNA, 23 nt, synthetic construct
  source 1..23: mol_type = other RNA
tagtctacaaaccagttgacctg

SEQ ID NO: 815 - RNA, 23 nt, synthetic construct
  source 1..23: mol_type = other RNA
tagtctacaaaccagttgacctg

SEQ ID NO: 816 - RNA, 23 nt, synthetic construct
  source 1..23: mol_type = other RNA
tagtctacaaaccagttgacctg

SEQ ID NO: 817 - RNA, 23 nt, synthetic construct
  source 1..23: mol_type = other RNA
tagtctacaaaccagttgacctg

SEQ ID NO: 818 - RNA, 23 nt, synthetic construct
  source 1..23: mol_type = other RNA
tagtctacaaaccagttgacctg

SEQ ID NO: 819 - RNA, 23 nt, synthetic construct
  source 1..23: mol_type = other RNA
tagtctacaaaccagttgacctg

SEQ ID NO: 820 - RNA, 23 nt, synthetic construct
  source 1..23: mol_type = other RNA
tagtctacaaaccagttgacctg

SEQ ID NO: 821 - RNA, 23 nt, synthetic construct
  source 1..23: mol_type = other RNA
aaatagtctacaaaccagttgac

SEQ ID NO: 822 - RNA, 23 nt, synthetic construct
  source 1..23: mol_type = other RNA
aaatagtctacaaaccagttgac

SEQ ID NO: 823 - RNA, 23 nt, synthetic construct
  source 1..23: mol_type = other RNA
aaatagtctacaaaccagttgac

SEQ ID NO: 824 - RNA, 23 nt, synthetic construct
  source 1..23: mol_type = other RNA
aaatagtctacaaaccagttgac

SEQ ID NO: 825 - RNA, 23 nt, synthetic construct
  source 1..23: mol_type = other RNA
aaatagtctacaaaccagttgac

SEQ ID NO: 826 - RNA, 22 nt, synthetic construct
  source 1..22: mol_type = other RNA
aatagtctacaaaccagttgac

SEQ ID NO: 827 - RNA, 21 nt, synthetic construct
  source 1..21: mol_type = other RNA
atagtctacaaaccagttgac

SEQ ID NO: 828 - RNA, 23 nt, synthetic construct
  source 1..23: mol_type = other RNA
aaatagtctacaaaccagttgac

SEQ ID NO: 829 - RNA, 23 nt, synthetic construct
  source 1..23: mol_type = other RNA
aaatagtctacaaaccagttgac

SEQ ID NO: 830 - RNA, 23 nt, synthetic construct
  source 1..23: mol_type = other RNA
aaatagtctacaaaccagttgac

SEQ ID NO: 831 - RNA, 23 nt, synthetic construct
  source 1..23: mol_type = other RNA
aaatagtctacaaaccagttgac

SEQ ID NO: 832 - RNA, 23 nt, synthetic construct
  source 1..23: mol_type = other RNA
aaatagtctacaaaccagttgac

SEQ ID NO: 833 - RNA, 23 nt, synthetic construct
  source 1..23: mol_type = other RNA
aaatagtctacaaaccagttgac

SEQ ID NO: 834 - RNA, 23 nt, synthetic construct
  source 1..23: mol_type = other RNA
aaatagtctacaaaccagttgac

SEQ ID NO: 835 - RNA, 23 nt, synthetic construct
  source 1..23: mol_type = other RNA
gcaaatagtctacaaaccagttg

SEQ ID NO: 836 - RNA, 23 nt, synthetic construct
  source 1..23: mol_type = other RNA
gcaaatagtctacaaaccagttg

SEQ ID NO: 837 - RNA, 23 nt, synthetic construct
  source 1..23: mol_type = other RNA
gcaaatagtctacaaaccagttg

SEQ ID NO: 838 - RNA, 23 nt, synthetic construct
  source 1..23: mol_type = other RNA
gcaaatagtctacaaaccagttg

SEQ ID NO: 839 - RNA, 23 nt, synthetic construct
  source 1..23: mol_type = other RNA
gcaaatagtctacaaaccagttg

SEQ ID NO: 840 - RNA, 23 nt, synthetic construct
  source 1..23: mol_type = other RNA
gcaaatagtctacaaaccagttg

SEQ ID NO: 841 - RNA, 23 nt, synthetic construct
  source 1..23: mol_type = other RNA
gcaaatagtctacaaaccagttg

SEQ ID NO: 842 - RNA, 23 nt, synthetic construct
  source 1..23: mol_type = other RNA
gcaaatagtctacaaaccagttg

SEQ ID NO: 843 - RNA, 23 nt, synthetic construct
  source 1..23: mol_type = other RNA
gcaaatagtctacaaaccagttg

SEQ ID NO: 844 - RNA, 23 nt, synthetic construct
  source 1..23: mol_type = other RNA
gcaaatagtctacaaaccagttg

SEQ ID NO: 845 - RNA, 23 nt, synthetic construct
  source 1..23: mol_type = other RNA
aagctcgcatggtcagtaaaagc

SEQ ID NO: 846 - RNA, 23 nt, synthetic construct
  source 1..23: mol_type = other RNA
aagctcgcatggtcagtaaaagc

SEQ ID NO: 847 - RNA, 23 nt, synthetic construct
  source 1..23: mol_type = other RNA
aagctcgcatggtcagtaaaagc

SEQ ID NO: 848 - RNA, 23 nt, synthetic construct
  source 1..23: mol_type = other RNA
aagctcgcatggtcagtaaaagc

SEQ ID NO: 849 - RNA, 23 nt, synthetic construct
  source 1..23: mol_type = other RNA
aagctcgcatggtcagtaaaagc

SEQ ID NO: 850 - RNA, 23 nt, synthetic construct
  source 1..23: mol_type = other RNA
aagctcgcatggtcagtaaaagc

SEQ ID NO: 851 - RNA, 23 nt, synthetic construct
  source 1..23: mol_type = other RNA
aagctcgcatggtcagtaaaagc

SEQ ID NO: 852 - RNA, 23 nt, synthetic construct
  source 1..23: mol_type = other RNA
aagctcgcatggtcagtaaaagc

SEQ ID NO: 853 - RNA, 23 nt, synthetic construct
  source 1..23: mol_type = other RNA
aagctcgcatggtcagtaaaagc

SEQ ID NO: 854 - RNA, 23 nt, synthetic construct
  source 1..23: mol_type = other RNA
aagctcgcatggtcagtaaaagc

SEQ ID NO: 855 - RNA, 23 nt, synthetic construct
  source 1..23: mol_type = other RNA
aagctcgcatggtcagtaaaagc

SEQ ID NO: 856 - RNA, 23 nt, synthetic construct
  source 1..23: mol_type = other RNA
aagctcgcatggtcagtaaaagc

SEQ ID NO: 857 - RNA, 23 nt, synthetic construct
  source 1..23: mol_type = other RNA
aagctcgcatggtcagtaaaagc

SEQ ID NO: 858 - RNA, 23 nt, synthetic construct
  source 1..23: mol_type = other RNA
aagctcgcatggtcagtaaaagc

SEQ ID NO: 859 - RNA, 23 nt, synthetic construct
  source 1..23: mol_type = other RNA
aaatctgagaagcttgacttcaa

SEQ ID NO: 860 - RNA, 23 nt, synthetic construct
  source 1..23: mol_type = other RNA
aaatctgagaagcttgacttcaa

SEQ ID NO: 861 - RNA, 23 nt, synthetic construct
  source 1..23: mol_type = other RNA
aaatctgagaagcttgacttcaa

SEQ ID NO: 862 - RNA, 23 nt, synthetic construct
  source 1..23: mol_type = other RNA
aaatctgagaagcttgacttcaa

SEQ ID NO: 863 - RNA, 23 nt, synthetic construct
  source 1..23: mol_type = other RNA
aaatctgagaagcttgacttcaa

SEQ ID NO: 864 - RNA, 23 nt, synthetic construct
  source 1..23: mol_type = other RNA
aaatctgagaagcttgacttcaa

SEQ ID NO: 865 - RNA, 23 nt, synthetic construct
  source 1..23: mol_type = other RNA
aaatctgagaagcttgacttcaa

SEQ ID NO: 866 - RNA, 23 nt, synthetic construct
  source 1..23: mol_type = other RNA
aaatctgagaagcttgacttcaa

SEQ ID NO: 867 - RNA, 23 nt, synthetic construct
  source 1..23: mol_type = other RNA
aaatctgagaagcttgacttcaa

SEQ ID NO: 868 - RNA, 23 nt, synthetic construct
  source 1..23: mol_type = other RNA
aaatctgagaagcttgacttcaa

SEQ ID NO: 869 - RNA, 23 nt, synthetic construct
  source 1..23: mol_type = other RNA
aaatctgagaagcttgacttcaa

SEQ ID NO: 870 - RNA, 21 nt, synthetic construct
  source 1..21: mol_type = other RNA
atctgagaagcttgacttcaa

SEQ ID NO: 871 - RNA, 21 nt, synthetic construct
  source 1..21: mol_type = other RNA
atctgagaagcttgacttcaa

SEQ ID NO: 872 - RNA, 23 nt, synthetic construct
  source 1..23: mol_type = other RNA
gcatggtcagtaaaagcaaagac

SEQ ID NO: 873 - RNA, 23 nt, synthetic construct
  source 1..23: mol_type = other RNA
gcatggtcagtaaaagcaaagac

SEQ ID NO: 874 - RNA, 23 nt, synthetic construct
  source 1..23: mol_type = other RNA
gcatggtcagtaaaagcaaagac

SEQ ID NO: 875 - RNA, 23 nt, synthetic construct
  source 1..23: mol_type = other RNA
gcatggtcagtaaaagcaaagac

SEQ ID NO: 876 - RNA, 23 nt, synthetic construct
  source 1..23: mol_type = other RNA
gcatggtcagtaaaagcaaagac

SEQ ID NO: 877 - RNA, 23 nt, synthetic construct
  source 1..23: mol_type = other RNA
gcatggtcagtaaaagcaaagac

SEQ ID NO: 878 - RNA, 23 nt, synthetic construct
  source 1..23: mol_type = other RNA
gcatggtcagtaaaagcaaagac

SEQ ID NO: 879 - RNA, 23 nt, synthetic construct
  source 1..23: mol_type = other RNA
gcatggtcagtaaaagcaaagac

SEQ ID NO: 880 - RNA, 23 nt, synthetic construct
  source 1..23: mol_type = other RNA
gcatggtcagtaaaagcaaagac

SEQ ID NO: 881 - RNA, 23 nt, synthetic construct
  source 1..23: mol_type = other RNA
gcatggtcagtaaaagcaaagac

SEQ ID NO: 882 - RNA, 23 nt, synthetic construct
  source 1..23: mol_type = other RNA
gcatggtcagtaaaagcaaagac

SEQ ID NO: 883 - RNA, 23 nt, synthetic construct
  source 1..23: mol_type = other RNA
gcatggtcagtaaaagcaaagac

SEQ ID NO: 884 - RNA, 23 nt, synthetic construct
  source 1..23: mol_type = other RNA
gcatggtcagtaaaagcaaagac

SEQ ID NO: 885 - RNA, 23 nt, synthetic construct
  source 1..23: mol_type = other RNA
gcatggtcagtaaaagcaaagac

SEQ ID NO: 886 - RNA, 23 nt, synthetic construct
  source 1..23: mol_type = other RNA
ctacaaaccagttgacctgagca

SEQ ID NO: 887 - RNA, 23 nt, synthetic construct
  source 1..23: mol_type = other RNA
ctacaaaccagttgacctgagca

SEQ ID NO: 888 - RNA, 23 nt, synthetic construct
  source 1..23: mol_type = other RNA
ctacaaaccagttgacctgagca

SEQ ID NO: 889 - RNA, 23 nt, synthetic construct
  source 1..23: mol_type = other RNA
ctacaaaccagttgacctgagca

SEQ ID NO: 890 - RNA, 23 nt, synthetic construct
  source 1..23: mol_type = other RNA
ctacaaaccagttgacctgagca

SEQ ID NO: 891 - RNA, 23 nt, synthetic construct
  source 1..23: mol_type = other RNA
ctacaaaccagttgacctgagca

SEQ ID NO: 892 - RNA, 23 nt, synthetic construct
  source 1..23: mol_type = other RNA
ctacaaaccagttgacctgagca

SEQ ID NO: 893 - RNA, 23 nt, synthetic construct
  source 1..23: mol_type = other RNA
ctacaaaccagttgacctgagca

SEQ ID NO: 894 - RNA, 23 nt, synthetic construct
  source 1..23: mol_type = other RNA
ctacaaaccagttgacctgagca

SEQ ID NO: 895 - RNA, 23 nt, synthetic construct
  source 1..23: mol_type = other RNA
ctacaaaccagttgacctgagca

SEQ ID NO: 896 - RNA, 23 nt, synthetic construct
  source 1..23: mol_type = other RNA
ctacaaaccagttgacctgagca

SEQ ID NO: 897 - RNA, 23 nt, synthetic construct
  source 1..23: mol_type = other RNA
ctacaaaccagttgacctgagca

SEQ ID NO: 898 - RNA, 23 nt, synthetic construct
  source 1..23: mol_type = other RNA
tttggaaataaagttattactct

SEQ ID NO: 899 - RNA, 23 nt, synthetic construct
  source 1..23: mol_type = other RNA
tttggaaataaagttattactct

SEQ ID NO: 900 - RNA, 23 nt, synthetic construct
  source 1..23: mol_type = other RNA
tttggaaataaagttattactct

SEQ ID NO: 901 - RNA, 23 nt, synthetic construct
  source 1..23: mol_type = other RNA
tttggaaataaagttattactct

SEQ ID NO: 902 - RNA, 23 nt, synthetic construct
  source 1..23: mol_type = other RNA
tttggaaataaagttattactct

SEQ ID NO: 903 - RNA, 23 nt, synthetic construct
  source 1..23: mol_type = other RNA
tttggaaataaagttattactct

SEQ ID NO: 904 - RNA, 23 nt, synthetic construct
  source 1..23: mol_type = other RNA
tttggaaataaagttattactct

SEQ ID NO: 905 - RNA, 23 nt, synthetic construct
  source 1..23: mol_type = other RNA
tttggaaataaagttattactct

SEQ ID NO: 906 - RNA, 23 nt, synthetic construct
  source 1..23: mol_type = other RNA
tttggaaataaagttattactct

SEQ ID NO: 907 - RNA, 23 nt, synthetic construct
  source 1..23: mol_type = other RNA
ctcgcatggtcagtaaaagcaaa

SEQ ID NO: 908 - RNA, 23 nt, synthetic construct
  source 1..23: mol_type = other RNA
ctcgcatggtcagtaaaagcaaa

SEQ ID NO: 909 - RNA, 23 nt, synthetic construct
  source 1..23: mol_type = other RNA
ctcgcatggtcagtaaaagcaaa

SEQ ID NO: 910 - RNA, 23 nt, synthetic construct
  source 1..23: mol_type = other RNA
ctcgcatggtcagtaaaagcaaa

SEQ ID NO: 911 - RNA, 23 nt, synthetic construct
  source 1..23: mol_type = other RNA
ctcgcatggtcagtaaaagcaaa

SEQ ID NO: 912 - RNA, 23 nt, synthetic construct
  source 1..23: mol_type = other RNA
ctcgcatggtcagtaaaagcaaa

SEQ ID NO: 913 - RNA, 23 nt, synthetic construct
  source 1..23: mol_type = other RNA
ctcgcatggtcagtaaaagcaaa

SEQ ID NO: 914 - RNA, 21 nt, synthetic construct
  source 1..21: mol_type = other RNA
cgcatggtcagtaaaagcaaa

SEQ ID NO: 915 - RNA, 21 nt, synthetic construct
  source 1..21: mol_type = other RNA
cgcatggtcagtaaaagcaaa

SEQ ID NO: 916 - RNA, 21 nt, synthetic construct
  source 1..21: mol_type = other RNA
cgcatggtcagtaaaagcaaa

SEQ ID NO: 917 - RNA, 23 nt, synthetic construct
  source 1..23: mol_type = other RNA
ctcgcatggtcagtaaaagcaaa

SEQ ID NO: 918 - RNA, 23 nt, synthetic construct
  source 1..23: mol_type = other RNA
ctcgcatggtcagtaaaagcaaa

SEQ ID NO: 919 - RNA, 23 nt, synthetic construct
  source 1..23: mol_type = other RNA
ctcgcatggtcagtaaaagcaaa

SEQ ID NO: 920 - RNA, 23 nt, synthetic construct
  source 1..23: mol_type = other RNA
ctcgcatggtcagtaaaagcaaa

SEQ ID NO: 921 - RNA, 23 nt, synthetic construct
  source 1..23: mol_type = other RNA
ctggtcacgtgacccaagctcgc

SEQ ID NO: 922 - RNA, 23 nt, synthetic construct
  source 1..23: mol_type = other RNA
tggtcacgtgacccaagctcgca

SEQ ID NO: 923 - RNA, 23 nt, synthetic construct
  source 1..23: mol_type = other RNA
ggtcacgtgacccaagctcgcat

SEQ ID NO: 924 - RNA, 23 nt, synthetic construct
  source 1..23: mol_type = other RNA
gtcacgtgacccaagctcgcatg

SEQ ID NO: 925 - RNA, 23 nt, synthetic construct
  source 1..23: mol_type = other RNA
gtcacgtgacccaagctcgcatg

SEQ ID NO: 926 - RNA, 23 nt, synthetic construct
  source 1..23: mol_type = other RNA
tcacgtgacccaagctcgcatgg

SEQ ID NO: 927 - RNA, 23 nt, synthetic construct
  source 1..23: mol_type = other RNA
cacgtgacccaagctcgcatggt

SEQ ID NO: 928 - RNA, 23 nt, synthetic construct
  source 1..23: mol_type = other RNA
acgtgacccaagctcgcatggtc

SEQ ID NO: 929 - RNA, 23 nt, synthetic construct
  source 1..23: mol_type = other RNA
cgtgacccaagctcgcatggtca

SEQ ID NO: 930 - RNA, 23 nt, synthetic construct
  source 1..23: mol_type = other RNA
gtgacccaagctcgcatggtcag

SEQ ID NO: 931 - RNA, 23 nt, synthetic construct
  source 1..23: mol_type = other RNA
tgacccaagctcgcatggtcagt

SEQ ID NO: 932 - RNA, 23 nt, synthetic construct
  source 1..23: mol_type = other RNA
gacccaagctcgcatggtcagta

SEQ ID NO: 933 - RNA, 23 nt, synthetic construct
  source 1..23: mol_type = other RNA
acccaagctcgcatggtcagtaa

SEQ ID NO: 934 - RNA, 23 nt, synthetic construct
  source 1..23: mol_type = other RNA
cccaagctcgcatggtcagtaaa

SEQ ID NO: 935 - RNA, 23 nt, synthetic construct
  source 1..23: mol_type = other RNA
ccaagctcgcatggtcagtaaaa

SEQ ID NO: 936 - RNA, 23 nt, synthetic construct
  source 1..23: mol_type = other RNA
caagctcgcatggtcagtaaaag

SEQ ID NO: 937 - RNA, 23 nt, synthetic construct
  source 1..23: mol_type = other RNA
agctcgcatggtcagtaaaagca

SEQ ID NO: 938 - RNA, 23 nt, synthetic construct
  source 1..23: mol_type = other RNA
gctcgcatggtcagtaaaagcaa

SEQ ID NO: 939 - RNA, 23 nt, synthetic construct
  source 1..23: mol_type = other RNA
ctcgcatggtcagtaaaagcaaa

SEQ ID NO: 940 - RNA, 23 nt, synthetic construct
  source 1..23: mol_type = other RNA
tcgcatggtcagtaaaagcaaag

SEQ ID NO: 941 - RNA, 23 nt, synthetic construct
  source 1..23: mol_type = other RNA
cgcatggtcagtaaaagcaaaga

SEQ ID NO: 942 - RNA, 23 nt, synthetic construct
  source 1..23: mol_type = other RNA
gcatggtcagtaaaagcaaagac

SEQ ID NO: 943 - RNA, 23 nt, synthetic construct
  source 1..23: mol_type = other RNA
catggtcagtaaaagcaaagacg

SEQ ID NO: 944 - RNA, 23 nt, synthetic construct
  source 1..23: mol_type = other RNA
atggtcagtaaaagcaaagacgg

SEQ ID NO: 945 - RNA, 23 nt, synthetic construct
  source 1..23: mol_type = other RNA
tggtcagtaaaagcaaagacggg

SEQ ID NO: 946 - RNA, 23 nt, synthetic construct
  source 1..23: mol_type = other RNA
tcagtaaaagcaaagacgggact

SEQ ID NO: 947 - RNA, 23 nt, synthetic construct
  source 1..23: mol_type = other RNA
tcagtaaaagcaaagacgggact

SEQ ID NO: 948 - RNA, 23 nt, synthetic construct
  source 1..23: mol_type = other RNA
gaaggtgcaaatagtctacaaac

SEQ ID NO: 949 - RNA, 23 nt, synthetic construct
  source 1..23: mol_type = other RNA
aaggtgcaaatagtctacaaacc

SEQ ID NO: 950 - RNA, 23 nt, synthetic construct
  source 1..23: mol_type = other RNA
aggtgcaaatagtctacaaacca

SEQ ID NO: 951 - RNA, 23 nt, synthetic construct
  source 1..23: mol_type = other RNA
ggtgcaaatagtctacaaaccag

SEQ ID NO: 952 - RNA, 23 nt, synthetic construct
  source 1..23: mol_type = other RNA
gtgcaaatagtctacaaaccagt

SEQ ID NO: 953 - RNA, 23 nt, synthetic construct
  source 1..23: mol_type = other RNA
tgcaaatagtctacaaaccagtt

SEQ ID NO: 954 - RNA, 23 nt, synthetic construct
  source 1..23: mol_type = other RNA
caaatagtctacaaaccagttga

SEQ ID NO: 955 - RNA, 23 nt, synthetic construct
  source 1..23: mol_type = other RNA
aaatagtctacaaaccagttgac

SEQ ID NO: 956 - RNA, 23 nt, synthetic construct
  source 1..23: mol_type = other RNA
aatagtctacaaaccagttgacc

SEQ ID NO: 957 - RNA, 23 nt, synthetic construct
  source 1..23: mol_type = other RNA
atagtctacaaaccagttgacct

SEQ ID NO: 958 - RNA, 23 nt, synthetic construct
  source 1..23: mol_type = other RNA
tagtctacaaaccagttgacctg

SEQ ID NO: 959 - RNA, 23 nt, synthetic construct
  source 1..23: mol_type = other RNA
agtctacaaaccagttgacctga

SEQ ID NO: 960 - RNA, 23 nt, synthetic construct
  source 1..23: mol_type = other RNA
gtctacaaaccagttgacctgag

SEQ ID NO: 961 - RNA, 23 nt, synthetic construct
  source 1..23: mol_type = other RNA
tctacaaaccagttgacctgagc

SEQ ID NO: 962 - RNA, 23 nt, synthetic construct
  source 1..23: mol_type = other RNA
ctacaaaccagttgacctgagca

SEQ ID NO: 963 - RNA, 23 nt, synthetic construct
  source 1..23: mol_type = other RNA
tacaaaccagttgacctgagcaa

SEQ ID NO: 964 - RNA, 23 nt, synthetic construct
  source 1..23: mol_type = other RNA
acaaaccagttgacctgagcaag

SEQ ID NO: 965 - RNA, 23 nt, synthetic construct
  source 1..23: mol_type = other RNA
caaaccagttgacctgagcaagg

SEQ ID NO: 966 - RNA, 23 nt, synthetic construct
  source 1..23: mol_type = other RNA
aaaccagttgacctgagcaaggt

SEQ ID NO: 967 - RNA, 23 nt, synthetic construct
  source 1..23: mol_type = other RNA
aaccagttgacctgagcaaggtg

SEQ ID NO: 968 - RNA, 23 nt, synthetic construct
  source 1..23: mol_type = other RNA
accagttgacctgagcaaggtga

SEQ ID NO: 969 - RNA, 23 nt, synthetic construct
  source 1..23: mol_type = other RNA
gaagtaaaatctgagaagcttga

SEQ ID NO: 970 - RNA, 23 nt, synthetic construct
  source 1..23: mol_type = other RNA
aagtaaaatctgagaagcttgac

SEQ ID NO: 971 - RNA, 23 nt, synthetic construct
  source 1..23: mol_type = other RNA
agtaaaatctgagaagcttgact

SEQ ID NO: 972 - RNA, 23 nt, synthetic construct
  source 1..23: mol_type = other RNA
gtaaaatctgagaagcttgactt

SEQ ID NO: 973 - RNA, 23 nt, synthetic construct
  source 1..23: mol_type = other RNA
taaaatctgagaagcttgacttc

SEQ ID NO: 974 - RNA, 23 nt, synthetic construct
  source 1..23: mol_type = other RNA
aaaatctgagaagcttgacttca

SEQ ID NO: 975 - RNA, 23 nt, synthetic construct
  source 1..23: mol_type = other RNA
aaatctgagaagcttgacttcaa

SEQ ID NO: 976 - RNA, 23 nt, synthetic construct
  source 1..23: mol_type = other RNA
aatctgagaagcttgacttcaag

SEQ ID NO: 977 - RNA, 23 nt, synthetic construct
  source 1..23: mol_type = other RNA
atctgagaagcttgacttcaagg

SEQ ID NO: 978 - RNA, 23 nt, synthetic construct
  source 1..23: mol_type = other RNA
tctgagaagcttgacttcaagga

SEQ ID NO: 979 - RNA, 23 nt, synthetic construct
  source 1..23: mol_type = other RNA
ctgagaagcttgacttcaaggac

SEQ ID NO: 980 - RNA, 23 nt, synthetic construct
  source 1..23: mol_type = other RNA
tgagaagcttgacttcaaggaca

SEQ ID NO: 981 - RNA, 23 nt, synthetic construct
  source 1..23: mol_type = other RNA
gagaagcttgacttcaaggacag

SEQ ID NO: 982 - RNA, 23 nt, synthetic construct
  source 1..23: mol_type = other RNA
aatttggaaataaagttattact

SEQ ID NO: 983 - RNA, 23 nt, synthetic construct
  source 1..23: mol_type = other RNA
atttggaaataaagttattactc

SEQ ID NO: 984 - RNA, 23 nt, synthetic construct
  source 1..23: mol_type = other RNA
atttggaaataaagttattactc

SEQ ID NO: 985 - RNA, 23 nt, synthetic construct
  source 1..23: mol_type = other RNA
tttggaaataaagttattactct

SEQ ID NO: 986 - RNA, 23 nt, synthetic construct
  source 1..23: mol_type = other RNA
tggaaataaagttattactctga

SEQ ID NO: 987 - RNA, 23 nt, synthetic construct
  source 1..23: mol_type = other RNA
ggaaataaagttattactctgat

SEQ ID NO: 988 - RNA, 23 nt, synthetic construct
  source 1..23: mol_type = other RNA
gaaataaagttattactctgatt

SEQ ID NO: 989 - RNA, 23 nt, synthetic construct
  source 1..23: mol_type = other RNA
aaataaagttattactctgatta

SEQ ID NO: 990 - RNA, 23 nt, synthetic construct
  source 1..23: mol_type = other RNA
tttggaaataaagttattactct

SEQ ID NO: 991 - RNA, 23 nt, synthetic construct
  source 1..23: mol_type = other RNA
ctcgcatggtcagtaaaagcaaa

SEQ ID NO: 992 - RNA, 82 nt, synthetic construct
  source 1..82: mol_type = other RNA
gtgcaaatagtctacaaaccagttgacctgagcaaggtgacctccaagtgtggctcattaggcaacatccatcataaaccag

SEQ ID NO: 993 - protein, 16 aa, synthetic construct
AAVALLPAVLLALLAP

SEQ ID NO: 994 - protein, 11 aa, synthetic construct
AALLPVLLAAP

SEQ ID NO: 995 - protein, 13 aa, synthetic construct
GRKKRRQRRRPPQ

SEQ ID NO: 996 - protein, 16 aa, synthetic construct
RQIKIWFQNRRMKWKK

SEQ ID NO: 997 - RNA, 21 nt, synthetic construct
  source 1..21: mol_type = other RNA
atagtctacaaaccagttgaa

SEQ ID NO: 998 - RNA, 21 nt, synthetic construct
  source 1..21: mol_type = other RNA
tgcaaatagtctacaaaccaa

SEQ ID NO: 999 - RNA, 21 nt, synthetic construct
  source 1..21: mol_type = other RNA
gtgacccaagctcgtatggta

SEQ ID NO: 1000 - RNA, 21 nt, synthetic construct
  source 1..21: mol_type = other RNA
gtgacccaagctcgcatggta

SEQ ID NO: 1001 - RNA, 23 nt, synthetic construct
  source 1..23: mol_type = other RNA
  modified_base 7: mod_base = OTHER; note = 5'-methyluridine-3'-phosphate
ttcaactggtttgtagactattt

SEQ ID NO: 1002 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
ttggtttgtagactatttgcaca

SEQ ID NO: 1003 - RNA, 23 nt, synthetic construct
  source 1..23: mol_type = other RNA
taccatacgagcttgggtcacgt

SEQ ID NO: 1004 - RNA, 23 nt, synthetic construct
  source 1..23: mol_type = other RNA
taccatgcgagcttgggtcacgt

SEQ ID NO: 1005 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
atagtctacaaaccagttgaa

SEQ ID NO: 1006 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine
tgcaaatagtctacaaaccaa

SEQ ID NO: 1007 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
gtgacccaagctcgtatggta

SEQ ID NO: 1008 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methyladenosine
gtgacccaagctcgcatggta

SEQ ID NO: 1009 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
ttcaactggtttgtagactattt

SEQ ID NO: 1010 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
ttggtttgtagactatttgcaca

SEQ ID NO: 1011 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6: note = RNA
  misc_feature 8..23: note = RNA
  misc_feature 5: note = DNA
  misc_feature 7: note = DNA
taccatacgagcttgggtcacgt

SEQ ID NO: 1012 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6: note = RNA
  misc_feature 8..23: note = RNA
  misc_feature 5: note = DNA
  misc_feature 7: note = DNA
taccatgcgagcttgggtcacgt

SEQ ID NO: 1013 - RNA, 23 nt, synthetic construct
  source 1..23: mol_type = other RNA
aaatagtctacaaaccagttgac

SEQ ID NO: 1014 - RNA, 23 nt, synthetic construct
  source 1..23: mol_type = other RNA
tgtgcaaatagtctacaaaccag

SEQ ID NO: 1015 - RNA, 23 nt, synthetic construct
  source 1..23: mol_type = other RNA
acgtgacccaagctcgcatggtc

SEQ ID NO: 1016 - RNA, 23 nt, synthetic construct
  source 1..23: mol_type = other RNA
acgtgacccaagctcgcatggtc

SEQ ID NO: 1017 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 12: mod_base = OTHER; note = 5'-methyluridine-3'-phosphate
ttctttgcttttactgaccatgc

SEQ ID NO: 1018 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 12: mod_base = OTHER; note = 5'-methyluridine-3'-phosphate
ttctttgcttttactgaccatgc

SEQ ID NO: 1019 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 12: mod_base = OTHER; note = 5'-methyluridine-3'-phosphate
ttctttgcttttactgtccatgc

SEQ ID NO: 1020 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 12: mod_base = OTHER; note = 5'-methyluridine-3'-phosphate
ttctttgcttttactgagcatgc

SEQ ID NO: 1021 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 12: mod_base = OTHER; note = 5'-methyluridine-3'-phosphate
ttctttgcttttactgacgatgc

SEQ ID NO: 1022 - RNA, 23 nt, synthetic construct
  source 1..23: mol_type = other RNA
  modified_base 4: mod_base = OTHER; note = 5'-methyluridine-3'-phosphate
  modified_base 6: mod_base = OTHER; note = 5'-methyluridine-3'-phosphate
ttctttgcttttactgaccatgc

SEQ ID NO: 1023 - RNA, 23 nt, synthetic construct
  source 1..23: mol_type = other RNA
  modified_base 4: mod_base = OTHER; note = 5'-methyluridine-3'-phosphate
  modified_base 6: mod_base = OTHER; note = 5'-methyluridine-3'-phosphate
  modified_base 12: mod_base = OTHER; note = 5'-methyluridine-3'-phosphate
ttctttgcttttactgaccatgc

SEQ ID NO: 1024 - RNA, 23 nt, synthetic construct
  source 1..23: mol_type = other RNA
  modified_base 2: mod_base = OTHER; note = 5'-methyluridine-3'-phosphate
  modified_base 4: mod_base = OTHER; note = 5'-methyluridine-3'-phosphate
  modified_base 6: mod_base = OTHER; note = 5'-methyluridine-3'-phosphate
  modified_base 12: mod_base = OTHER; note = 5'-methyluridine-3'-phosphate
ttctttgcttttactgaccatgc

SEQ ID NO: 1025 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 12: mod_base = OTHER; note = 5'-methyluridine-3'-phosphate
ttcttcgcttttactgaccatgc

SEQ ID NO: 1026 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 12: mod_base = OTHER; note = 5'-methyluridine-3'-phosphate
ttctttacttttactgaccatgc

SEQ ID NO: 1027 - RNA, 23 nt, synthetic construct
  source 1..23: mol_type = other RNA
  modified_base 2: mod_base = OTHER; note = 5'-methyluridine-3'-phosphate
  modified_base 5: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
ttcttttcttttactgaccatgc

SEQ ID NO: 1028 - RNA, 23 nt, synthetic construct
  source 1..23: mol_type = other RNA
  modified_base 4: mod_base = OTHER; note = 5'-methyluridine-3'-phosphate
tgctcaggtcaactggtttgtag

SEQ ID NO: 1029 - RNA, 23 nt, synthetic construct
  source 1..23: mol_type = other RNA
  modified_base 4: mod_base = OTHER; note = 5'-methyluridine-3'-phosphate
tgctcaggtcaactggattgtag

SEQ ID NO: 1030 - RNA, 23 nt, synthetic construct
  source 1..23: mol_type = other RNA
  modified_base 4: mod_base = OTHER; note = 5'-methyluridine-3'-phosphate
tgctcaggtcaactggtatgtag

SEQ ID NO: 1031 - RNA, 23 nt, synthetic construct
  source 1..23: mol_type = other RNA
  modified_base 4: mod_base = OTHER; note = 5'-methyluridine-3'-phosphate
tgctcaggtcaactggttagtag

SEQ ID NO: 1032 - RNA, 23 nt, synthetic construct
  source 1..23: mol_type = other RNA
tgctcaagtcaactggtttgtag

SEQ ID NO: 1033 - RNA, 23 nt, synthetic construct
  source 1..23: mol_type = other RNA
tgctcaagtcaactggattgtag

SEQ ID NO: 1034 - RNA, 23 nt, synthetic construct
  source 1..23: mol_type = other RNA
tgctcaagtcaactggtatgtag

SEQ ID NO: 1035 - RNA, 23 nt, synthetic construct
  source 1..23: mol_type = other RNA
tgctcaagtcaactggttagtag

SEQ ID NO: 1036 - RNA, 23 nt, synthetic construct
  source 1..23: mol_type = other RNA
tgctctggtcaactggtttgtag

SEQ ID NO: 1037 - RNA, 23 nt, synthetic construct
  source 1..23: mol_type = other RNA
tgctctggtcaactggattgtag

SEQ ID NO: 1038 - RNA, 23 nt, synthetic construct
  source 1..23: mol_type = other RNA
tgctctggtcaactggtatgtag

SEQ ID NO: 1039 - RNA, 23 nt, synthetic construct
  source 1..23: mol_type = other RNA
tgctctggtcaactggttagtag

SEQ ID NO: 1040 - RNA, 23 nt, synthetic construct
  source 1..23: mol_type = other RNA
tgagtaataactttatttccaaa

SEQ ID NO: 1041 - RNA, 23 nt, synthetic construct
  source 1..23: mol_type = other RNA
  modified_base 5: mod_base = OTHER; note = 5'-methyluridine-3'-phosphate
tgagtaataactttatttccaaa

SEQ ID NO: 1042 - RNA, 23 nt, synthetic construct
  source 1..23: mol_type = other RNA
  modified_base 5: mod_base = OTHER; note = 5'-methyluridine-3'-phosphate
tgagtaataactttatttccagg

SEQ ID NO: 1043 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
tgagtaataactttatttccagg

SEQ ID NO: 1044 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
  modified_base 16: mod_base = OTHER; note = 5'-methyluridine-3'-phosphate
tgagtaataactttatttccagg

SEQ ID NO: 1045 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
tgagtaataactttatttccagg

SEQ ID NO: 1046 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
tgagtaataactttatatccagg

SEQ ID NO: 1047 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
tgagtaataactttattaccagg

SEQ ID NO: 1048 - RNA, 23 nt, synthetic construct
  source 1..23: mol_type = other RNA
  modified_base 5: mod_base = OTHER; note = 5'-methyluridine-3'-phosphate
  modified_base 12: mod_base = OTHER; note = 5'-methyluridine-3'-phosphate
tgagtaataactttatttgcagg

SEQ ID NO: 1049 - RNA, 23 nt, synthetic construct
  source 1..23: mol_type = other RNA
tttgcttttactgaccatgcgag

SEQ ID NO: 1050 - RNA, 23 nt, synthetic construct
  source 1..23: mol_type = other RNA
  modified_base 7: mod_base = OTHER; note = 5'-methyluridine-3'-phosphate
tttgcttttactgaccatgcgag

SEQ ID NO: 1051 - RNA, 23 nt, synthetic construct
  source 1..23: mol_type = other RNA
  modified_base 7: mod_base = OTHER; note = 5'-methyluridine-3'-phosphate
tttgcttttactgaccatgcggg

SEQ ID NO: 1052 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
tttgcttttactgaccatgcggg

SEQ ID NO: 1053 - RNA, 23 nt, synthetic construct
  source 1..23: mol_type = other RNA
  modified_base 7: mod_base = OTHER; note = 5'-methyluridine-3'-phosphate
  modified_base 12: mod_base = OTHER; note = 5'-methyluridine-3'-phosphate
tttgcttttactgaccatgcggg

SEQ ID NO: 1054 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
tttgcttttactgaccatgcggg

SEQ ID NO: 1055 - RNA, 23 nt, synthetic construct
  source 1..23: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
tttgcttttactgaccatgcggg

SEQ ID NO: 1056 - RNA, 21 nt, synthetic construct
  source 1..21: mol_type = other RNA
  modified_base 7: mod_base = OTHER; note = 5'-methyluridine-3'-phosphate
tttgcttttactgaccatgcg

SEQ ID NO: 1057 - RNA, 21 nt, synthetic construct
  source 1..21: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
tttgcttttactgaccatgcg

SEQ ID NO: 1058 - RNA, 21 nt, synthetic construct
  source 1..21: mol_type = other RNA
  modified_base 2: mod_base = OTHER; note = 5'-methyluridine-3'-phosphate
  modified_base 7: mod_base = OTHER; note = 5'-methyluridine-3'-phosphate
  modified_base 12: mod_base = OTHER; note = 5'-methyluridine-3'-phosphate
tttgcttttactgaccatgcg

SEQ ID NO: 1059 - RNA, 23 nt, synthetic construct
  source 1..23: mol_type = other RNA
  modified_base 7: mod_base = OTHER; note = 5'-methyluridine-3'-phosphate
tttgcttttactgaccatgcgag

SEQ ID NO: 1060 - RNA, 23 nt, synthetic construct
  source 1..23: mol_type = other RNA
  modified_base 7: mod_base = OTHER; note = 5'-methyluridine-3'-phosphate
tttgcttttactgaccttgcgag

SEQ ID NO: 1061 - RNA, 23 nt, synthetic construct
  source 1..23: mol_type = other RNA
  modified_base 7: mod_base = OTHER; note = 5'-methyluridine-3'-phosphate
tttgcttttactgaccaagcgag

SEQ ID NO: 1062 - RNA, 23 nt, synthetic construct
  source 1..23: mol_type = other RNA
  modified_base 7: mod_base = OTHER; note = 5'-methyluridine-3'-phosphate
tttgcttttactgaccatccgag

SEQ ID NO: 1063 - RNA, 23 nt, synthetic construct
  source 1..23: mol_type = other RNA
  modified_base 7: mod_base = OTHER; note = 5'-methyluridine-3'-phosphate
tcgagcttgggtcacgtgaccag

SEQ ID NO: 1064 - RNA, 23 nt, synthetic construct
  source 1..23: mol_type = other RNA
tgcgagcttgggtcacgtgacca

SEQ ID NO: 1065 - RNA, 23 nt, synthetic construct
  source 1..23: mol_type = other RNA
ttgcgagcttgggtcacgtgacc

SEQ ID NO: 1066 - RNA, 23 nt, synthetic construct
  source 1..23: mol_type = other RNA
tatgcgagcttgggtcacgtgac

SEQ ID NO: 1067 - RNA, 23 nt, synthetic construct
  source 1..23: mol_type = other RNA
tatgcgagcttgggtcacgtgac

SEQ ID NO: 1068 - RNA, 23 nt, synthetic construct
  source 1..23: mol_type = other RNA
tcatgcgagcttgggtcacgtga

SEQ ID NO: 1069 - RNA, 23 nt, synthetic construct
  source 1..23: mol_type = other RNA
  modified_base 5: mod_base = OTHER; note = 5'-methyluridine-3'-phosphate
tccatgcgagcttgggtcacgtg

SEQ ID NO: 1070 - RNA, 23 nt, synthetic construct
  source 1..23: mol_type = other RNA
taccatgcgagcttgggtcacgt

SEQ ID NO: 1071 - RNA, 23 nt, synthetic construct
  source 1..23: mol_type = other RNA
  modified_base 7: mod_base = OTHER; note = 5'-methyluridine-3'-phosphate
tgaccatgcgagcttgggtcacg

SEQ ID NO: 1072 - RNA, 23 nt, synthetic construct
  source 1..23: mol_type = other RNA
ttgaccatgcgagcttgggtcac

SEQ ID NO: 1073 - RNA, 23 nt, synthetic construct
  source 1..23: mol_type = other RNA
tctgaccatgcgagcttgggtca

SEQ ID NO: 1074 - RNA, 23 nt, synthetic construct
  source 1..23: mol_type = other RNA
tactgaccatgcgagcttgggtc

SEQ ID NO: 1075 - RNA, 23 nt, synthetic construct
  source 1..23: mol_type = other RNA
  modified_base 5: mod_base = OTHER; note = 5'-methyluridine-3'-phosphate
ttactgaccatgcgagcttgggt

SEQ ID NO: 1076 - RNA, 23 nt, synthetic construct
  source 1..23: mol_type = other RNA
tttactgaccatgcgagcttggg

SEQ ID NO: 1077 - RNA, 23 nt, synthetic construct
  source 1..23: mol_type = other RNA
  modified_base 7: mod_base = OTHER; note = 5'-methyluridine-3'-phosphate
ttttactgaccatgcgagcttgg

SEQ ID NO: 1078 - RNA, 23 nt, synthetic construct
  source 1..23: mol_type = other RNA
  modified_base 5: mod_base = OTHER; note = 5'-methyluridine-3'-phosphate
tttttactgaccatgcgagcttg

SEQ ID NO: 1079 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
tgcttttactgaccatgcgagct

SEQ ID NO: 1080 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
ttgcttttactgaccatgcgagc

SEQ ID NO: 1081 - RNA, 23 nt, synthetic construct
  source 1..23: mol_type = other RNA
  modified_base 7: mod_base = OTHER; note = 5'-methyluridine-3'-phosphate
tttgcttttactgaccatgcgag

SEQ ID NO: 1082 - RNA, 23 nt, synthetic construct
  source 1..23: mol_type = other RNA
  modified_base 7: mod_base = OTHER; note = 5'-methyluridine-3'-phosphate
ttttgcttttactgaccatgcga

SEQ ID NO: 1083 - RNA, 23 nt, synthetic construct
  source 1..23: mol_type = other RNA
  modified_base 5: mod_base = OTHER; note = 5'-methyluridine-3'-phosphate
tctttgcttttactgaccatgcg

SEQ ID NO: 1084 - RNA, 23 nt, synthetic construct
  source 1..23: mol_type = other RNA
  modified_base 5: mod_base = OTHER; note = 5'-methyluridine-3'-phosphate
ttctttgcttttactgaccatgc

SEQ ID NO: 1085 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
tgtctttgcttttactgaccatg

SEQ ID NO: 1086 - RNA, 23 nt, synthetic construct
  source 1..23: mol_type = other RNA
  modified_base 7: mod_base = OTHER; note = 5'-methyluridine-3'-phosphate
tcgtctttgcttttactgaccat

SEQ ID NO: 1087 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
tccgtctttgcttttactgacca

SEQ ID NO: 1088 - RNA, 23 nt, synthetic construct
  source 1..23: mol_type = other RNA
  modified_base 12: mod_base = OTHER; note = 5'-methyluridine-3'-phosphate
tgtcccgtctttgcttttactga

SEQ ID NO: 1089 - RNA, 23 nt, synthetic construct
  source 1..23: mol_type = other RNA
tgtcccgtctttgcttttactga

SEQ ID NO: 1090 - RNA, 23 nt, synthetic construct
  source 1..23: mol_type = other RNA
ttttgtagactatttgcacactg

SEQ ID NO: 1091 - RNA, 23 nt, synthetic construct
  source 1..23: mol_type = other RNA
  modified_base 5: mod_base = OTHER; note = 5'-methyluridine-3'-phosphate
  modified_base 7: mod_base = OTHER; note = 5'-methyluridine-3'-phosphate
tgtttgtagactatttgcacact

SEQ ID NO: 1092 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggtcagtaaaagcaaagaa

SEQ ID NO: 1093 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggtcagtaaaagcaaagaa

SEQ ID NO: 1094 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggtcagtaaaagcaaagaa

SEQ ID NO: 1095 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggtcagtaaaagcgaagaa

SEQ ID NO: 1096 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggtcagtaaaagtaaagaa

SEQ ID NO: 1097 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggtcagtaaaagaaaagaa

SEQ ID NO: 1098 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaaaccagttgacctgagca

SEQ ID NO: 1099 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaatccagttgacctgagca

SEQ ID NO: 1100 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcataccagttgacctgagca

SEQ ID NO: 1101 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctaaccagttgacctgagca

SEQ ID NO: 1102 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaaaccagttgacttgagca

SEQ ID NO: 1103 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaatccagttgacttgagca

SEQ ID NO: 1104 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcataccagttgacttgagca

SEQ ID NO: 1105 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctaaccagttgacttgagca

SEQ ID NO: 1106 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaaaccagttgacctgagca

SEQ ID NO: 1107 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaatccagttgaccagagca

SEQ ID NO: 1108 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcataccagttgaccagagca

SEQ ID NO: 1109 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctaaccagttgaccagagca

SEQ ID NO: 1110 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggaaataaagttattactca

SEQ ID NO: 1111 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggaaataaagttattactca

SEQ ID NO: 1112 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggaaataaagttattactca

SEQ ID NO: 1113 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggaaataaagttattactca

SEQ ID NO: 1114 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggaaataaagttattactca

SEQ ID NO: 1115 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggaaataaagttattactca

SEQ ID NO: 1116 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-adenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggatataaagttattactca

SEQ ID NO: 1117 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggtaataaagttattactca

SEQ ID NO: 1118 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgcaaataaagttattactca

SEQ ID NO: 1119 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-hexadecyl-adenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgcatggtcagtaaaagcaaa

SEQ ID NO: 1120 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-hexadecyl-adenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgcatggtcagtaaaagcaaa

SEQ ID NO: 1121 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-hexadecyl-adenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgcatggtcagtaaaagcaaa

SEQ ID NO: 1122 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-hexadecyl-adenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgcatggtcagtaaaagcaaa

SEQ ID NO: 1123 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-hexadecyl-adenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgcatggtcagtaaaagcaaa

SEQ ID NO: 1124 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-hexadecyl-adenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgcatggtcagtaaaagcaaa

SEQ ID NO: 1125 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-hexadecyl-adenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgcatggtcagtaaaagcaaa

SEQ ID NO: 1126 - RNA, 19 nt, synthetic construct
  source 1..19: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-hexadecyl-adenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catggtcagtaaaagcaaa

SEQ ID NO: 1127 - RNA, 19 nt, synthetic construct
  source 1..19: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-hexadecyl-adenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catggtcagtaaaagcaaa

SEQ ID NO: 1128 - RNA, 19 nt, synthetic construct
  source 1..19: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-deoxy-2'-fluoroguanosine-3'-phosphate
  modified_base 6: mod_base = OTHER; note = 2'-O-methyluridine-3'-phosphate
  modified_base 7: mod_base = OTHER; note = 2'-deoxy-2'-fluorocytidine-3'-phosphate
  modified_base 8: mod_base = OTHER; note = 2'-deoxy-2'-fluoroadenosine-3'-phosphate
  modified_base 9: mod_base = OTHER; note = 2'-deoxy-2'-fluoroguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-hexadecyl-adenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catggtcagtaaaagcaaa

SEQ ID NO: 1129 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-hexadecyl-adenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgcatggtcagtaaaagcaaa

SEQ ID NO: 1130 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-hexadecyl-adenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgcaaggtcagtaaaagcaaa

SEQ ID NO: 1131 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-hexadecyl-adenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgcttggtcagtaaaagcaaa

SEQ ID NO: 1132 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-hexadecyl-adenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cggatggtcagtaaaagcaaa

SEQ ID NO: 1133 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggtcacgtgacccaagctcga

SEQ ID NO: 1134 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtcacgtgacccaagctcgca

SEQ ID NO: 1135 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcacgtgacccaagctcgcaa

SEQ ID NO: 1136 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacgtgacccaagctcgcata

SEQ ID NO: 1137 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacgtgacccaagctcgcata

SEQ ID NO: 1138 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acgtgacccaagctcgcatga

SEQ ID NO: 1139 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgtgacccaagctcgcatgga

SEQ ID NO: 1140 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgacccaagctcgcatggta

SEQ ID NO: 1141 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgacccaagctcgcatggtca

SEQ ID NO: 1142 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacccaagctcgcatggtcaa

SEQ ID NO: 1143 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acccaagctcgcatggtcaga

SEQ ID NO: 1144 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-cytidine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cccaagctcgcatggtcagta

SEQ ID NO: 1145 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methylcytidine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccaagctcgcatggtcagtaa

SEQ ID NO: 1146 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagctcgcatggtcagtaaa

SEQ ID NO: 1147 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroguanosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagctcgcatggtcagtaaaa

SEQ ID NO: 1148 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-hexadecyl-cytidine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agctcgcatggtcagtaaaaa

SEQ ID NO: 1149 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctcgcatggtcagtaaaagca

SEQ ID NO: 1150 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroguanosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcgcatggtcagtaaaagcaa

SEQ ID NO: 1151 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-hexadecyl-uridine-3'-phosphate
  modified_base 6: mod_base = OTHER; note = 2'-O-methylguanosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgcatggtcagtaaaagcaaa

SEQ ID NO: 1152 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcatggtcagtaaaagcaaaa

SEQ ID NO: 1153 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catggtcagtaaaagcaaaga

SEQ ID NO: 1154 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggtcagtaaaagcaaagaa

SEQ ID NO: 1155 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggtcagtaaaagcaaagaca

SEQ ID NO: 1156 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggtcagtaaaagcaaagacga

SEQ ID NO: 1157 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtcagtaaaagcaaagacgga

SEQ ID NO: 1158 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtaaaagcaaagacgggaca

SEQ ID NO: 1159 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtaaaagcaaagacgggaca

SEQ ID NO: 1160 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgtgcaaatagtctacaaaa

SEQ ID NO: 1161 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtgcaaatagtctacaaaca

SEQ ID NO: 1162 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgcaaatagtctacaaacca

SEQ ID NO: 1163 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgcaaatagtctacaaaccaa

SEQ ID NO: 1164 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaaatagtctacaaaccaga

SEQ ID NO: 1165 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caaatagtctacaaaccagta

SEQ ID NO: 1166 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorocytidine-3'-phosphate
  modified_base 8: mod_base = OTHER; note = 2'-O-methyluridine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatagtctacaaaccagttga

SEQ ID NO: 1167 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorouridine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atagtctacaaaccagttgaa

SEQ ID NO: 1168 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tagtctacaaaccagttgaca

SEQ ID NO: 1169 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtctacaaaccagttgacca

SEQ ID NO: 1170 - RNA, 21 nt, synthetic construct
  source 1..21: mol_type = other RNA
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtctacaaaccagttgaccta

SEQ ID NO: 1171 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctacaaaccagttgacctga

SEQ ID NO: 1172 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroadenosine-3'-phosphate
  modified_base 8: mod_base = OTHER; note = 2'-O-methylcytidine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctacaaaccagttgacctgaa

SEQ ID NO: 1173 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluorocytidine-3'-phosphate
  modified_base 8: mod_base = OTHER; note = 2'-O-methylcytidine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacaaaccagttgacctgaga

SEQ ID NO: 1174 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluorocytidine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acaaaccagttgacctgagca

SEQ ID NO: 1175 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-hexadecyl-cytidine-3'-phosphate
  modified_base 7: mod_base = OTHER; note = 2'-deoxy-2'-fluoroadenosine-3'-phosphate
  modified_base 8: mod_base = OTHER; note = 2'-O-methylguanosine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluorouridine-3'-phosphate
  modified_base 11: mod_base = OTHER; note = 2'-deoxy-2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caaaccagttgacctgagcaa

SEQ ID NO: 1176 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-hexadecyl-adenosine-3'-phosphate
  modified_base 7: mod_base = OTHER; note = 2'-deoxy-2'-fluoroguanosine-3'-phosphate
  modified_base 8: mod_base = OTHER; note = 2'-O-methyluridine-3'-phosphate
  modified_base 9: mod_base = OTHER; note = 2'-deoxy-2'-fluorouridine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaccagttgacctgagcaaa

SEQ ID NO: 1177 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-hexadecyl-uridine-3'-phosphate
  modified_base 8: mod_base = OTHER; note = 2'-O-methyluridine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroadenosine-3'-phosphate
  modified_base 11: mod_base = OTHER; note = 2'-deoxy-2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaccagttgacctgagcaaga

SEQ ID NO: 1178 - RNA, 21 nt, synthetic construct
  source 1..21: mol_type = other RNA
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-hexadecyl-uridine-3'-phosphate
  modified_base 7: mod_base = OTHER; note = 2'-deoxy-2'-fluorouridine-3'-phosphate
  modified_base 8: mod_base = OTHER; note = 2'-O-methylguanosine-3'-phosphate
  modified_base 9: mod_base = OTHER; note = 2'-deoxy-2'-fluoroadenosine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accagttgacctgagcaagga

SEQ ID NO: 1179 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-hexadecyl-uridine-3'-phosphate
  modified_base 7: mod_base = OTHER; note = 2'-deoxy-2'-fluoroguanosine-3'-phosphate
  modified_base 8: mod_base = OTHER; note = 2'-O-methyladenosine-3'-phosphate
  modified_base 9: mod_base = OTHER; note = 2'-deoxy-2'-fluorocytidine-3'-phosphate
  modified_base 10: mod_base = OTHER; note = 2'-deoxy-2'-fluorocytidine-3'-phosphate
  modified_base 11: mod_base = OTHER; note = 2'-deoxy-2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccagttgacctgagcaaggta

SEQ ID NO: 1180 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-deoxy-2'-fluoroadenosine-3'-phosphate
  modified_base 7: mod_base = OTHER; note = 2'-O-methyladenosine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluoroadenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
tgagtaataactttatttccaaa

SEQ ID NO: 1181 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
tgagtaataactttatttccaaa

SEQ ID NO: 1182 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tgagtaataactttatttccagg

SEQ ID NO: 1183 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..11: note = RNA
  misc_feature 13..23: note = RNA
  misc_feature 5: note = DNA
  misc_feature 12: note = DNA
tgagtaataactttatttccagg

SEQ ID NO: 1184 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..11: note = RNA
  misc_feature 13..15: note = RNA
  misc_feature 17..23: note = RNA
  misc_feature 5: note = DNA
  misc_feature 12: note = DNA
  misc_feature 16: note = DNA
tgagtaataactttatttccagg

SEQ ID NO: 1185 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6..11: note = RNA
  misc_feature 13..23: note = RNA
  misc_feature 2: note = DNA
  misc_feature 5: note = DNA
  misc_feature 12: note = DNA
tgagtaataactttatttccagg

SEQ ID NO: 1186 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..11: note = RNA
  misc_feature 13..23: note = RNA
  misc_feature 5: note = DNA
  misc_feature 12: note = DNA
tgagtaataactttatatccagg

SEQ ID NO: 1187 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..11: note = RNA
  misc_feature 13..23: note = RNA
  misc_feature 5: note = DNA
  misc_feature 12: note = DNA
tgagtaataactttattaccagg

SEQ ID NO: 1188 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..11: note = RNA
  misc_feature 13..23: note = RNA
  misc_feature 5: note = DNA
  misc_feature 12: note = DNA
tgagtaataactttatttgcagg

SEQ ID NO: 1189 - RNA, 23 nt, synthetic construct
  source 1..23: mol_type = other RNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-deoxy-2'-fluorouridine-3'-phosphate
  modified_base 7: mod_base = OTHER; note = 2'-O-methyluridine-3'-phosphate
  modified_base 8: mod_base = OTHER; note = 2'-deoxy-2'-fluorouridine-3'-phosphate
  modified_base 9: mod_base = OTHER; note = 2'-deoxy-2'-fluorouridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
tttgcttttactgaccatgcgag

SEQ ID NO: 1190 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tttgcttttactgaccatgcgag

SEQ ID NO: 1191 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tttgcttttactgaccatgcggg

SEQ ID NO: 1192 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..11: note = RNA
  misc_feature 13..23: note = RNA
  misc_feature 5: note = DNA
  misc_feature 12: note = DNA
tttgcttttactgaccatgcggg

SEQ ID NO: 1193 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..11: note = RNA
  misc_feature 13..15: note = RNA
  misc_feature 17..23: note = RNA
  misc_feature 5: note = DNA
  misc_feature 12: note = DNA
  misc_feature 16: note = DNA
tttgcttttactgaccatgcggg

SEQ ID NO: 1194 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6..11: note = RNA
  misc_feature 13..15: note = RNA
  misc_feature 17..23: note = RNA
  misc_feature 2: note = DNA
  misc_feature 5: note = DNA
  misc_feature 12: note = DNA
  misc_feature 16: note = DNA
tttgcttttactgaccatgcggg

SEQ ID NO: 1195 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1: note = RNA
  misc_feature 3..4: note = RNA
  misc_feature 6..11: note = RNA
  misc_feature 13: note = RNA
  misc_feature 15: note = RNA
  misc_feature 17..23: note = RNA
  misc_feature 2: note = DNA
  misc_feature 5: note = DNA
  misc_feature 12: note = DNA
  misc_feature 14: note = DNA
  misc_feature 16: note = DNA
tttgcttttactgaccatgcggg

SEQ ID NO: 1196 - DNA, 21 bp, synthetic construct
  source 1..21: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methylguanosine
  misc_feature 1..4: note = RNA
  misc_feature 6..21: note = RNA
  misc_feature 5: note = DNA
tttgcttttactgaccatgcg

SEQ ID NO: 1197 - DNA, 21 bp, synthetic construct
  source 1..21: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methylguanosine
  misc_feature 1: note = RNA
  misc_feature 3..4: note = RNA
  misc_feature 6..11: note = RNA
  misc_feature 13..21: note = RNA
  misc_feature 2: note = DNA
  misc_feature 5: note = DNA
  misc_feature 12: note = DNA
tttgcttttactgaccatgcg

SEQ ID NO: 1198 - DNA, 21 bp, synthetic construct
  source 1..21: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methylguanosine
  misc_feature 1: note = RNA
  misc_feature 3..4: note = RNA
  misc_feature 6..11: note = RNA
  misc_feature 13..15: note = RNA
  misc_feature 17..21: note = RNA
  misc_feature 2: note = DNA
  misc_feature 5: note = DNA
  misc_feature 12: note = DNA
  misc_feature 16: note = DNA
tttgcttttactgaccatgcg

SEQ ID NO: 1199 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tttgcttttactgaccatgcgag

SEQ ID NO: 1200 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tttgcttttactgaccttgcgag

SEQ ID NO: 1201 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tttgcttttactgaccaagcgag

SEQ ID NO: 1202 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tttgcttttactgaccatccgag

SEQ ID NO: 1203 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tcgagcttgggtcacgtgaccag

SEQ ID NO: 1204 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
tgcgagcttgggtcacgtgacca

SEQ ID NO: 1205 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
ttgcgagcttgggtcacgtgacc

SEQ ID NO: 1206 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tatgcgagcttgggtcacgtgac

SEQ ID NO: 1207 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
tatgcgagcttgggtcacgtgac

SEQ ID NO: 1208 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = guanosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
tcatgcgagcttgggtcacgtga

SEQ ID NO: 1209 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = cytidine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tccatgcgagcttgggtcacgtg

SEQ ID NO: 1210 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
taccatgcgagcttgggtcacgt

SEQ ID NO: 1211 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tgaccatgcgagcttgggtcacg

SEQ ID NO: 1212 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
ttgaccatgcgagcttgggtcac

SEQ ID NO: 1213 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
tctgaccatgcgagcttgggtca

SEQ ID NO: 1214 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = cytidine-2'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
tactgaccatgcgagcttgggtc

SEQ ID NO: 1215 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
ttactgaccatgcgagcttgggt

SEQ ID NO: 1216 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tttactgaccatgcgagcttggg

SEQ ID NO: 1217 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
ttttactgaccatgcgagcttgg

SEQ ID NO: 1218 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tttttactgaccatgcgagcttg

SEQ ID NO: 1219 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
tgcttttactgaccatgcgagct

SEQ ID NO: 1220 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
ttgcttttactgaccatgcgagc

SEQ ID NO: 1221 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tttgcttttactgaccatgcgag

SEQ ID NO: 1222 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
ttttgcttttactgaccatgcga

SEQ ID NO: 1223 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tctttgcttttactgaccatgcg

SEQ ID NO: 1224 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
ttctttgcttttactgaccatgc

SEQ ID NO: 1225 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tgtctttgcttttactgaccatg

SEQ ID NO: 1226 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
tcgtctttgcttttactgaccat

SEQ ID NO: 1227 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
tccgtctttgcttttactgacca

SEQ ID NO: 1228 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tgtcccgtctttgcttttactga

SEQ ID NO: 1229 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
tgtcccgtctttgcttttactga

SEQ ID NO: 1230 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
ttttgtagactatttgcacactg

SEQ ID NO: 1231 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
tgtttgtagactatttgcacact

SEQ ID NO: 1232 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
tggtttgtagactatttgcacac

SEQ ID NO: 1233 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
ttggtttgtagactatttgcaca

SEQ ID NO: 1234 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
tctggtttgtagactatttgcac

SEQ ID NO: 1235 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
tactggtttgtagactatttgca

SEQ ID NO: 1236 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tcaactggtttgtagactatttg

SEQ ID NO: 1237 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
ttcaactggtttgtagactattt

SEQ ID NO: 1238 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
tgtcaactggtttgtagactatt

SEQ ID NO: 1239 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
tggtcaactggtttgtagactat

SEQ ID NO: 1240 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
taggtcaactggtttgtagacta

SEQ ID NO: 1241 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
tcaggtcaactggtttgtagact

SEQ ID NO: 1242 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
ttcaggtcaactggtttgtagac

SEQ ID NO: 1243 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluoroguanosine-3'-phosphate
  modified_base 15: mod_base = OTHER; note = 2'-O-methylguanosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
tctcaggtcaactggtttgtaga

SEQ ID NO: 1244 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylguanosine-3'-phosphate
  modified_base 16: mod_base = OTHER; note = 2'-deoxy-2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tgctcaggtcaactggtttgtag

SEQ ID NO: 1245 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
ttgctcaggtcaactggtttgta

SEQ ID NO: 1246 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
tttgctcaggtcaactggtttgt

SEQ ID NO: 1247 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
tcttgctcaggtcaactggtttg

SEQ ID NO: 1248 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
tccttgctcaggtcaactggttt

SEQ ID NO: 1249 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
taccttgctcaggtcaactggtt

SEQ ID NO: 1250 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-deoxy-2'-fluoroguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tcaccttgctcaggtcaactggt

SEQ ID NO: 1251 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
tcaagcttctcagattttacttc

SEQ ID NO: 1252 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methyladenosine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
ttcaagcttctcagattttactt

SEQ ID NO: 1253 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
tgtcaagcttctcagattttact

SEQ ID NO: 1254 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
tagtcaagcttctcagattttac

SEQ ID NO: 1255 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA), S-isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
taagtcaagcttctcagatttta

SEQ ID NO: 1256 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
tgaagtcaagcttctcagatttt

SEQ ID NO: 1257 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA), S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methylcytidine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
ttgaagtcaagcttctcagattt

SEQ ID NO: 1258 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
tttgaagtcaagcttctcagatt

SEQ ID NO: 1259 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA), S-isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-deoxy-2'-fluorocytidine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
tcttgaagtcaagcttctcagat

SEQ ID NO: 1260 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tccttgaagtcaagcttctcaga

SEQ ID NO: 1261 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-deoxy-2'-fluoroadenosine-3'-phosphate
  modified_base 15: mod_base = OTHER; note = 2'-O-methylguanosine-3'-phosphate
  modified_base 16: mod_base = OTHER; note = 2'-deoxy-2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine
  misc_feature 1..4: note = RNA
  misc_feature 6..23: note = RNA
  misc_feature 5: note = DNA
ttccttgaagtcaagcttctcag

SEQ ID NO: 1262 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = Thymidine-glycol nucleic acid (GNA), S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-deoxy-2'-fluoroadenosine-3'-phosphate
  modified_base 15: mod_base = OTHER; note = 2'-O-methyladenosine-3'-phosphate
  modified_base 16: mod_base = OTHER; note = 2'-deoxy-2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine
  misc_feature 1..4: note = RNA
  misc_feature 6..23: note = RNA
  misc_feature 5: note = DNA
tgtccttgaagtcaagcttctca

SEQ ID NO: 1263 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA), S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-deoxy-2'-fluorocytidine-3'-phosphate
  modified_base 15: mod_base = OTHER; note = 2'-O-methyladenosine-3'-phosphate
  modified_base 16: mod_base = OTHER; note = 2'-deoxy-2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine
  misc_feature 1..4: note = RNA
  misc_feature 6..23: note = RNA
  misc_feature 5: note = DNA
ttgtccttgaagtcaagcttctc

SEQ ID NO: 1264 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-deoxy-2'-fluorouridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tgtaataactttatttccaaatt

SEQ ID NO: 1265 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tagtaataactttatttccaaat

SEQ ID NO: 1266 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxy-2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA), S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-deoxy-2'-fluoroadenosine-3'-phosphate
  modified_base 15: mod_base = OTHER; note = 2'-O-methyluridine-3'-phosphate
  modified_base 16: mod_base = OTHER; note = 2'-deoxy-2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine
  misc_feature 1..4: note = RNA
  misc_feature 6..23: note = RNA
  misc_feature 5: note = DNA
tagtaataactttatttccaaat

SEQ ID NO: 1267 - DNA, 23 bp, synthetic construct
  source 1..23: mol_type = other DNA
  modified_base 1: mod_base = OTHER; note = 2'-O-methyluridine-3'-phosphorothioate 5'-(E)-Vinylphosphonate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-deoxy-2'-fluorouridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine
  misc_feature 1: note = RNA
  misc_feature 3..4: note = RNA
  misc_feature 6: note = RNA
  misc_feature 8..11: note = RNA
  misc_feature 13..23: note = RNA
  misc_feature 2: note = DNA
  misc_feature 5: note = DNA
  misc_feature 7: note = DNA
  misc_feature 12: note = DNA
tgagtaataactttatttccaaa

SEQ ID NO: 1268 - RNA, 23 nt, synthetic construct
  source 1..23: mol_type = other RNA
taccatncgagcttgggtcacgt

SEQ ID NO: 1269 - RNA, 23 nt, synthetic construct
  source 1..23: mol_type = other RNA
taccathcgagcttgggtcacgt

We claim:

1. A double-stranded ribonucleic acid (dsRNA) agent, or a pharmaceutically acceptable salt thereof, comprising a sense strand and an antisense strand forming a double-stranded region, wherein the antisense strand comprises the nucleotide sequence, 5'-VPusAfsccdAudAcgagcuUfgGfgucacsgsu-3' (SEQ ID. NO: 1011), wherein VP is a 5'-vinyl phosphonate;

s is a phosphorothioate linkage;

a, c, g, and u are 2'-O-methyl (2'-OMe) A, C, G, and U, respectively;

dA is 2'-deoxy A; and

Af, Gf, Uf are 2'-deoxy-2'-fluoro (2'-F) A, G, and U, respectively.

2. The dsRNA agent of claim 1, or a pharmaceutically acceptable salt thereof, wherein the sense strand comprises the nucleotide sequence, 5'-gsusgac (Chd) caAfGfCfucguauggsusa-3' (SEQ ID. NO: 1007), wherein (Chd) is 2'-O-hexadecyl-cytidine-3'-phosphate;

s is a phosphorothioate linkage;

a, c, g, and u are 2'-O-methyl (2'-OMe) A, C, G, and U, respectively; and

Af, Cf, and Gf are 2'-deoxy-2'-fluoro (2'-F) A, C, and G, respectively.

3. A double-stranded ribonucleic acid (dsRNA) agent, or a pharmaceutically acceptable salt thereof, comprising a sense strand and an antisense strand forming a double-stranded region, wherein the sense strand consists of the nucleotide sequence, 5'-gsusgac (Chd) caAfGfCfucguauggsusa-3' (SEQ ID. NO: 1007), and the antisense strand consists of the nucleotide sequence, 5'-VPusAfsccdAudAcgagcuUfgGfgucacsgsu-3' (SEQ ID. NO: 1011), wherein VP is a 5'-vinyl phosphonate;

s is a phosphorothioate linkage;

a, c, g, and u are 2'-O-methyl (2'-OMe) A, C, G, and U, respectively;

dA is 2'-deoxy A;

Af, Cf, Gf, Uf are 2'-deoxy-2'-fluoro (2'-F) A, C, G, and U, respectively; and (Chd) is 2'-O-hexadecyl-cytidine-3'-phosphate.

4. A double-stranded ribonucleic acid (dsRNA) agent for inhibiting expression of *MAPT*, wherein the dsRNA agent comprises a sense strand and an antisense strand forming a double stranded region, wherein the antisense strand comprises a region of complementarity to an mRNA encoding Tau, and wherein the region of complementarity comprises at least nucleotides 2-18 of the antisense sequence, counting from the 5'-end of the antisense sequence, (SEQ ID NO: 1003)
UACCAUACGAGCUUGGGUCACGU.

5. The dsRNA agent, or pharmaceutically acceptable salt thereof, of claim 4, wherein the region of complementarity comprises at least 19 contiguous nucleotides of the antisense sequence.

6. The dsRNA agent, or pharmaceutically acceptable salt thereof, of claim 4, wherein the sense strand comprises the nucleotide sequence SEQ ID NO: 999.

7. The dsRNA agent, or pharmaceutically acceptable salt thereof, of claim 4, wherein the antisense strand comprises the nucleotide sequence SEQ ID NO: 1003.

8. The dsRNA agent, or pharmaceutically acceptable salt thereof, of claim 7, wherein the sense strand comprises the nucleotide sequence SEQ ID NO: 999.

9. The dsRNA agent, or pharmaceutically acceptable salt thereof, of claim 4, wherein the sense strand consists of the nucleotide sequence SEQ ID NO: 999, and the antisense strand consists of the nucleotide sequence SEQ ID NO: 1003.

10. The dsRNA agent of claim 4, wherein the dsRNA agent comprises at least one modified nucleotide.

11. The dsRNA agent of claim 10, wherein the at least one modified nucleotide is selected from the group consisting of a deoxy-nucleotide, a 3'-terminal deoxythymidine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxyl-modified nucleotide, a 2'-methoxyethyl modified nucleotide, a 2'-O-alkyl-modified nucleotide, a morpholino nucleotide, a phosphoramidate, a non-natural nucleotide base, a tetrahydropyran modified nucleotide, a 1,5-anhydrohexitol modified nucleotide, a cyclohexenyl modified nucleotide, a nucleotide comprising a 5'-phosphorothioate group, a nucleotide comprising a 5'-methylphosphonate group, a nucleotide comprising a 5' phosphate or 5' phosphate mimic, a nucleotide comprising vinyl phosphonate, a glycol nucleic acid (GNA), a glycol nucleic acid S-Isomer (S-GNA), a 2'-5'-linked ribonucleotides ("3'-RNA"), nucleotide comprising 2-hydroxymethyl-tetrahydrofuran-5-phosphate, a nucleotide comprising 2'-deoxythymidine-3'phosphate, a nucleotide comprising 2'-deoxyguanosine-3'-phosphate, and a terminal nucleotide linked to a cholesteryl derivative and a dodecanoic acid bisdecylamide group; and combinations thereof.

12. The dsRNA agent of claim 4, wherein at least one strand comprises a 3' overhang of 1 or 2 nucleotides.

13. The dsRNA agent of claim 4, wherein each strand has 19-23 nucleotides and the double-stranded region is 17-23 in length.

14. The dsRNA agent of claim 4, wherein the sense strand has a total of 21 nucleotides and the antisense strand has a total of 23 nucleotides.

15. The dsRNA agent of claim 4, further comprising at least one phosphorothioate internucleotide linkage.

16. The dsRNA agent of claim 15, wherein the dsRNA agent comprises 6-8 phosphorothioate internucleotide linkages.

17. The dsRNA agent of claim 4, further comprising a phosphate or phosphate mimic at the 5'-end of the antisense strand.

18. The dsRNA agent of claim 17, wherein the phosphate mimic is a 5'-vinyl phosphonate (VP).

19. The dsRNA agent of claim 4, wherein the base pair at the 1 position of the 5'-end of the antisense strand of the double-stranded region is an AU base pair.

20. The dsRNA agent of claim 4, wherein the sense strand, the antisense strand, or both the sense strand and the antisense strand is conjugated to one or more lipophilic moieties.

21. The dsRNA agent of claim 20, wherein the one or more lipophilic moieties are conjugated to one or more of the internal positions selected from the group consisting of positions 4-8 and 13-18 on the sense strand, and positions 6-10 and 15-18 on the antisense strand, counting from the 5'end of each strand.

22. The dsRNA agent of claim 20, wherein the one or more lipophilic moieties contain a saturated or unsaturated C4-C30 hydrocarbon chain, and an optional functional group selected from the group consisting of hydroxyl, amine, carboxylic acid, sulfonate, phosphate, thiol, azide, and alkyne.

23. The dsRNA agent of claim 20, wherein the one or more lipophilic moieties are conjugated to a nucleobase, sugar moiety, or internucleosidic linkage.

24. The dsRNA agent of claim 20, wherein the one or more lipophilic moieties contain a saturated or unsaturated C16 hydrocarbon chain.

25. The dsRNA agent of claim 24, wherein the saturated or unsaturated C16 hydrocarbon chain is conjugated to position 6 or 7 of the sense strand, counting from the 5'-end of the sense strand.

26. The dsRNA agent of claim 2 that is a pharmaceutically acceptable salt.

27. The dsRNA agent of claim 26 that is the sodium salt.

28. The dsRNA agent of claim 3 that is a pharmaceutically acceptable salt.

29. The dsRNA agent of claim 28 that is the sodium salt.

* * * * *